(12) United States Patent
Killoran et al.

(10) Patent No.: US 11,767,517 B2
(45) Date of Patent: Sep. 26, 2023

(54) LUCIFERASE ENZYMES FOR USE WITH THERMOSTABLE LUCIFERINS IN BIOLUMINESCENT ASSAYS

(71) Applicant: Promega Corporation, Madison, WI (US)

(72) Inventors: Michael Killoran, Madison, WI (US); Ce Shi, Madison, WI (US); Mary Hall, Madison, WI (US); Lance P. Encell, Madison, WI (US); Thomas Kirkland, Madison, WI (US)

(73) Assignee: Promega Corporation, Madison, WI (US)

( * ) Notice: Subject to any disclaimer, the term of this patent is extended or adjusted under 35 U.S.C. 154(b) by 876 days.

(21) Appl. No.: 16/432,674

(22) Filed: Jun. 5, 2019

(65) Prior Publication Data

US 2020/0071682 A1 Mar. 5, 2020

Related U.S. Application Data

(60) Provisional application No. 62/680,899, filed on Jun. 5, 2018.

(51) Int. Cl.
   *C12N 9/02* (2006.01)
   *G01N 21/76* (2006.01)

(52) U.S. Cl.
   CPC .......... *C12N 9/0069* (2013.01); *C12Y 113/12* (2013.01); *G01N 21/763* (2013.01)

(58) Field of Classification Search
   CPC ... C12N 9/0069; C12Y 113/12; G01N 21/763
   See application file for complete search history.

(56) References Cited

U.S. PATENT DOCUMENTS

| | | | | |
|---|---|---|---|---|
| 8,822,170 | B2 * | 9/2014 | Wood | C12N 9/0069 435/8 |
| 10,400,264 | B2 | 9/2019 | Encell et al. | |
| 2009/0286299 | A1 | 11/2009 | Ronaghi et al. | |
| 2011/0283373 | A1 * | 11/2011 | Binkowski | C12N 9/0069 435/243 |

FOREIGN PATENT DOCUMENTS

| | | | | |
|---|---|---|---|---|
| WO | WO 95/18853 A1 | 7/1995 | | |
| WO | WO-9518853 A1 * | 7/1995 | ........... | C12N 9/0069 |
| WO | WO-2011008912 A1 * | 1/2011 | ........... | C07D 417/04 |
| WO | WO 2018/071807 A2 | 4/2018 | | |
| WO | WO 2018/102726 A1 | 6/2018 | | |

OTHER PUBLICATIONS

Berg, JM et al. Biochemistry Fifth Edition, W.H. Freeman and Company, New York, pp. 176-177. 2002 (Year: 2002).*
Singh RK et al. 2017. Protein Engineering Approaches in the Post-Genomic Era. Current Protein and Peptide Science. 18, 1-11. (Year: 2017).*
Zhang M et al. Propagated Perturbations from a Peripheral Mutation Show Interactions Supporting WW Domain Thermostability. 2018. Structure. 26, 1474-1485. (Year: 2018).*
International Search Report and Written Opinion for PCT/US2019/035626, dated Oct. 25, 2019. 41 pages.
Auld et al., A basis for reduced chemical library inhibition of firefly luciferase obtained from directed evolution. J Med Chem. Mar. 12, 2009;52(5):1450-8.
Jones et al., Orthogonal Luciferase-Luciferin Pairs for Bioluminescence Imaging. J Am Chem Soc. Feb. 15, 2017;139(6):2351-2358.
Miller et al., Lessons Learned from Luminous Luciferins and Latent Luciferases. ACS Chem Biol. Jul. 20, 2018;13(7):1734-1740.
Rathbun et al., Bioluminescent Probes for Imaging Biology beyond the Culture Dish. Biochemistry. Oct. 3, 2017;56(39):5178-5184.
Rathbun et al.,Parallel Screening for Rapid Identification of Orthogonal Bioluminescent Tools. ACS Cent Sci. Dec. 27, 2017;3(12):1254-1261.
Viviani et al., Bioluminescence of beetle luciferases with 6'-amino-D-luciferin analogues reveals excited keto-oxyluciferin as the emitter and phenolate/luciferin binding site interactions modulate bioluminescence colors. Biochemistry. Aug. 19, 2014;53(32):5208-20.

\* cited by examiner

*Primary Examiner* — Paul J Holland
(74) *Attorney, Agent, or Firm* — Casimir Jones, S.C.; Peter J. Schlueter

(57) ABSTRACT

Provided herein are enhanced luciferase enzymes for use with thermostable luciferin analogs for bioluminescent assays. In particular, the present disclosure provides compositions, assays, and methods for performing a bioluminescent assay using enhanced, high-activity luciferase enzymes compatible with thermostable luciferins, such as 5,5-disubstituted luciferin analogs.

26 Claims, 55 Drawing Sheets

Specification includes a Sequence Listing.

epPCR Mutants Rnd 1 – Shuffling hits

C4582F2 (P1B4)
H244W+T344A+I396K+S193A+N228D+L305F

C4583A3 (P1B6)
H244W+T344A+I396K+N228D+V297I

C4584D7 (P1B10)
H244W+T344A+I396K+N228D+V300G+L305F

C4615B7 (P1F11)
H244W+T344A+I396K+N228D+L305F epPCR mutants Rnd 1 – Combinatorial analysis

ATG3550
H244W+T344A+I396K+V300G+L305F

ATG3551
H244W+T344A+I396K+V300G+S306P

ATG3552
H244W+T344A+I396K+V300G+L305P+S306P

ATG3553
H244W+T344A+I396K+L305P+S306P

Combinatorial analysis

ATG2879
H244W+Y254S+T344A+I396K

ATG2884
H244W+Y254S

ATG2885
H244W+T344A

ATG2886
H244W+I396K

ATG2887
H244W+Y254S+T344A

ATG2888
H244W+Y254S+I396K

ATG2889
H244W+T344A+I396K

ATG2890
I240L+H244W+Y254S+T344A+I396K

ATG3549
H244W+T344A+I396K+V300G

Dehydro-LH2 resistant

ATG2624
I240L+Y254S+T344A+I396K

ATG2625
N74N+H244R+V300G+I396K

Site-saturation screen

ATG2877
H244W

Rational mutagenesis

ATG2671
G245A+L285I+G315A

ATG2287
(Ppe Variant)

FIG. 2A

Linear regression analysis

ATG3673
H244W+Y254S+T344A+I109V+S193A+F218L+N228D+S234T+V262A+L294H+L305F+S306P+K307E+A316S+V335G+V353M

ATG3674 *
H244W+Y254S+T344A+S193A+N228D+L305F+S306P

ATG3675
H244W+Y254S+T344A+I109V+V262A+L305F+S306P+V353M epPCR Mutants Rnd 1 – Secondary screen mutants

ATG3707
H244W+Y254S+T344A+S193A+N228D+L305F+S306P+I109V

ATG3708
H244W+Y254S+T344A+S193A+N228D+L305F+S306P+Q133H

ATG3709
H244W+Y254S+T344A+S193A+N228D+L305F+S306P+I214L

ATG3710
H244W+Y254S+T344A+S193A+N228D+L305F+S306P+F218L

ATG3711
H244W+Y254S+T344A+S193A+N228D+L305F+S306P+T233S

ATG3712
H244W+Y254S+T344A+S193A+N228D+L305F+S306P+S234T

ATG3713
H244W+Y254S+T344A+S193A+N228D+L305F+S306P+I236V

ATG3714
H244W+Y254S+T344A+S193A+N228D+L305F+S306P+V262A

ATG3715
H244W+Y254S+T344A+S193A+N228D+L305F+S306P+V335G

ATG3716
H244W+Y254S+T344A+S193A+N228D+L305F+S306P+S503R

ATG3717
H244W+Y254S+T344A+S193A+N228D+L305F+S306P+I214L+F218L

ATG3718
H244W+Y254S+T344A+S193A+N228D+L305F+S306P+T233S+S234T

ATG3719
H244W+Y254S+T344A+S193A+N228D+L305F+S306P+S234T+I236V

ATG3720
H244W+Y254S+T344A+S193A+N228D+L305F+S306P+T233S+I236V

FIG. 2B

DNA shuffling Mutants Round 2

C2240E2  H244W+Y254S+T344A+S193A+N228D+L305F+S306P+I109V+I230F+V335G+I410M
C2261D9
C2242E1  H244W+Y254S+T344A+S193A+N228D+L305F+S306P+I109V+C38S+Y108F+T376I
C2260B6  H244W+Y254S+T344A+S193A+N228D+L305F+S306P+I109V+C38S+F55I+V262A+I422V
C2158H1  H244W+Y254S+T344A+S193A+N228D+L305F+S306P+I109V+Y108F+V261A+N427D+F431V
C2158A3  H244W+Y254S+T344A+S193A+N228D+L305F+S306P+I109V+I230F
C2158H3  H244W+Y254S+T344A+S193A+N228D+L305F+S306P+I109V+Q487R
C2262C2  H244W+Y254S+T344A+S193A+N228D+L305F+S306P+I109V+N154S+V261A+I410M
C2159F8  H244W+Y254S+T344A+S193A+N228D+L305F+S306P+I109V+Y183C+V261A+T289S
C2149A12 H244W+Y254S+T344A+S193A+N228D+L305F+S306P+I109V+Y32C
C2261E4  H244W+Y254S+T344A+S193A+N228D+L305F+S306P+I109V+F246Y+V261A
C2160C1  H244W+Y254S+T344A+S193A+N228D+L305F+S306P+I109V+I230F
C2261D1  H244W+Y254S+T344A+S193A+N228D+L305F+S306P+I109V+K121Q+F246Y+V261A
         H244W+Y254S+T344A+S193A+N228D+L305F+S306P+I109V+K121Q+V261A+V287I

ATG3707 → H244W+Y254S+T344A+S193A+N228D+L305F+S306P+I109V

FIG. 2C

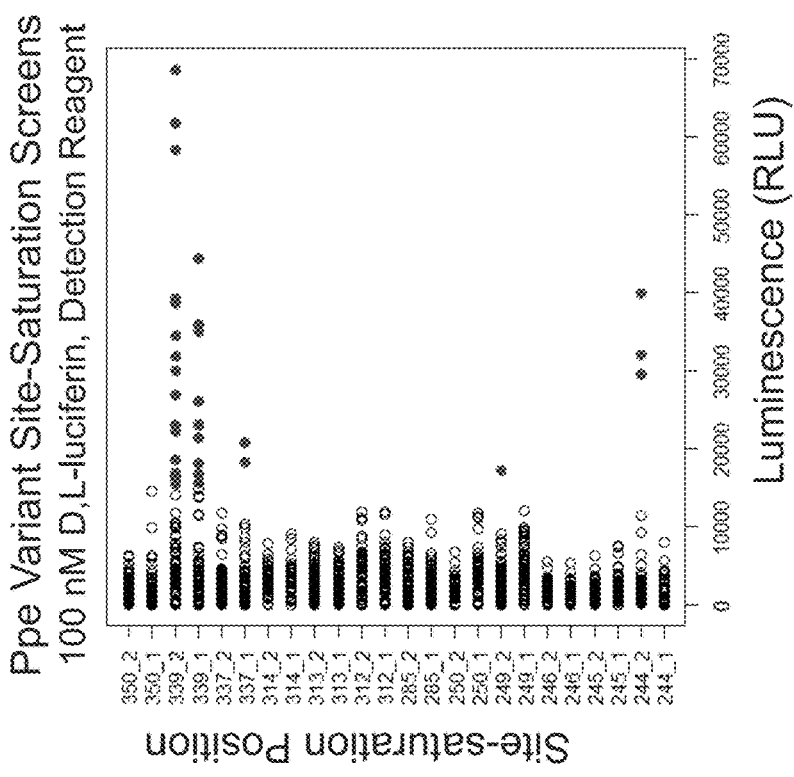
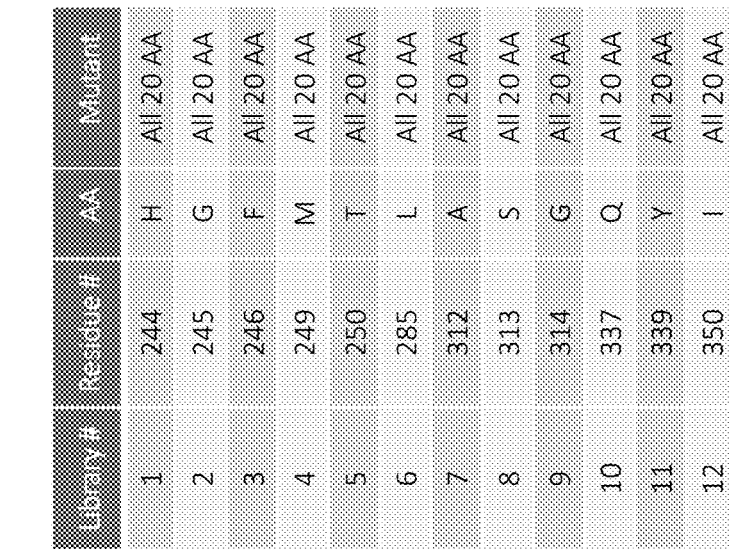
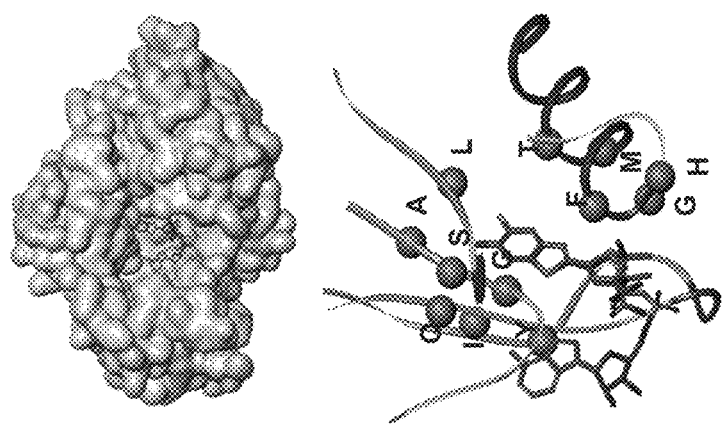
FIG. 4

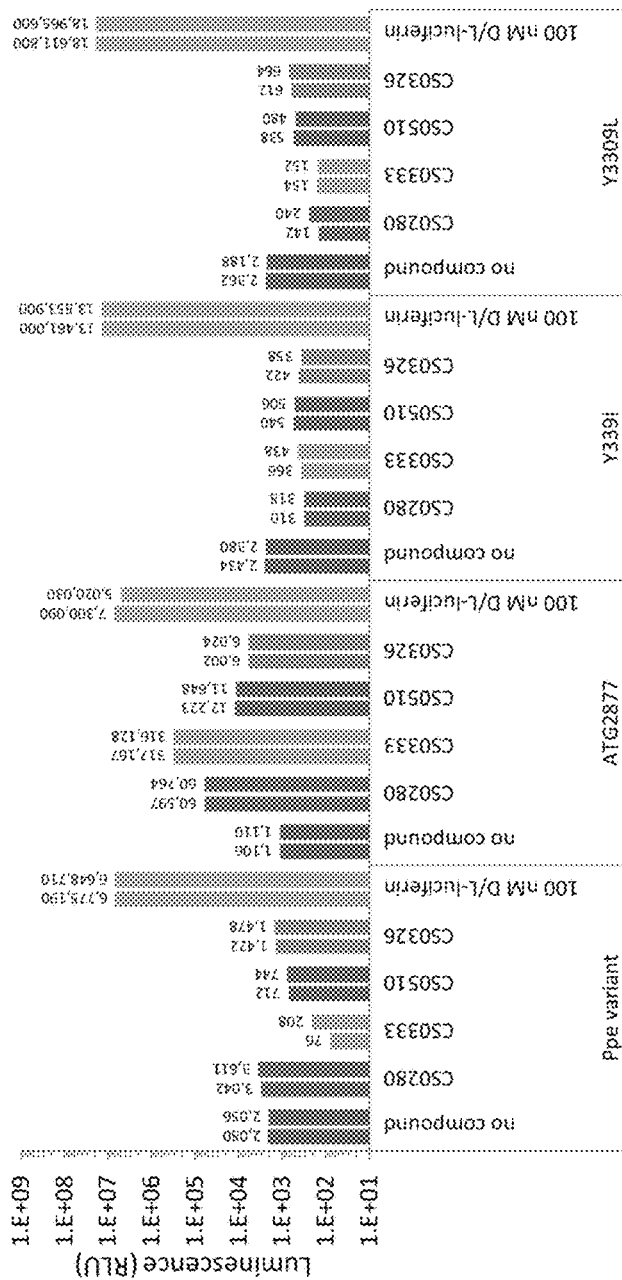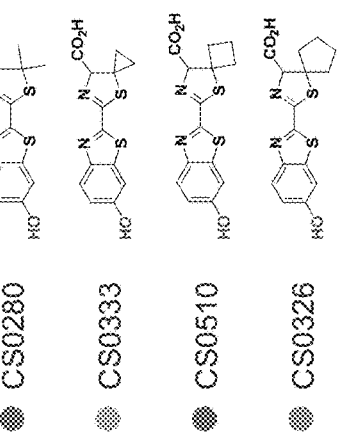
FIG. 7

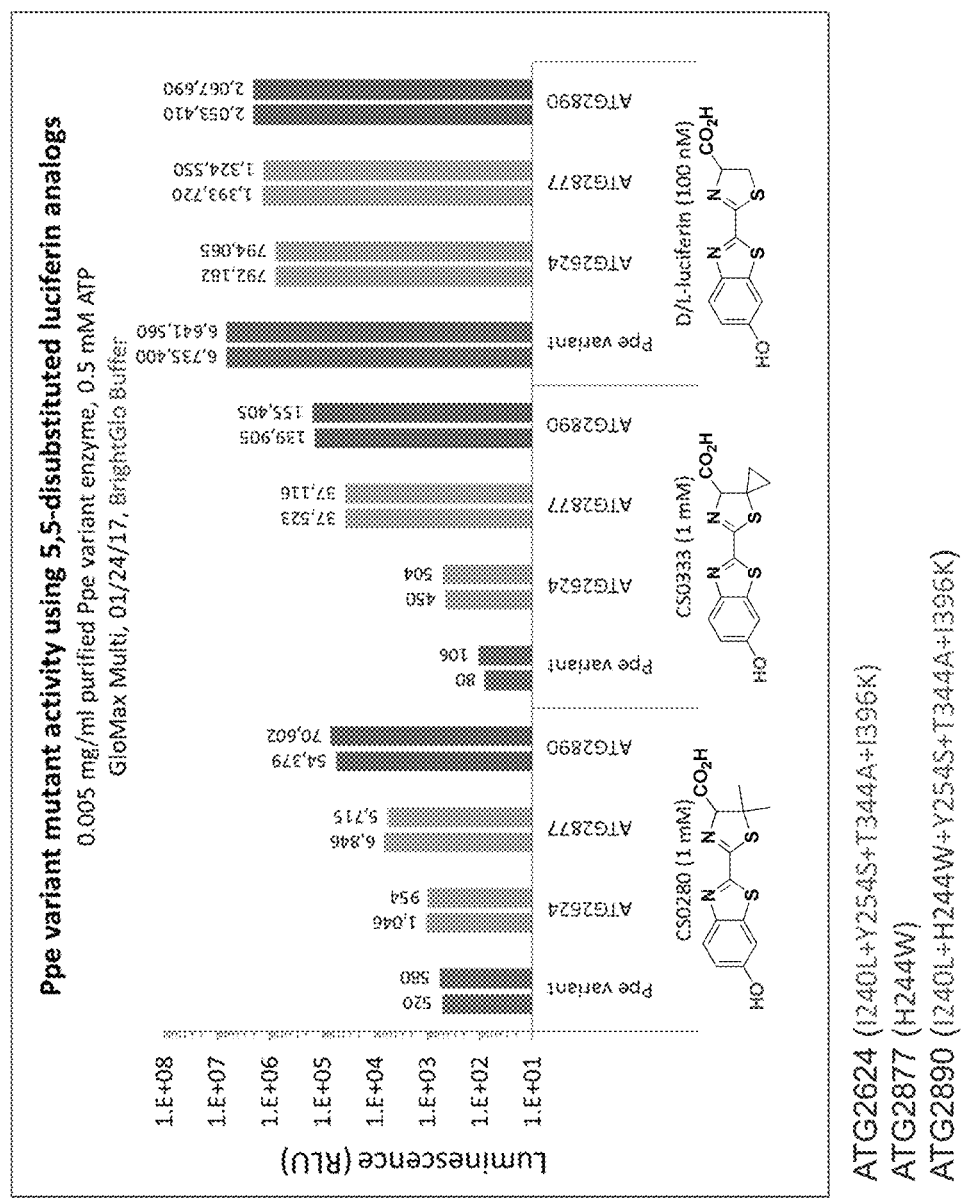
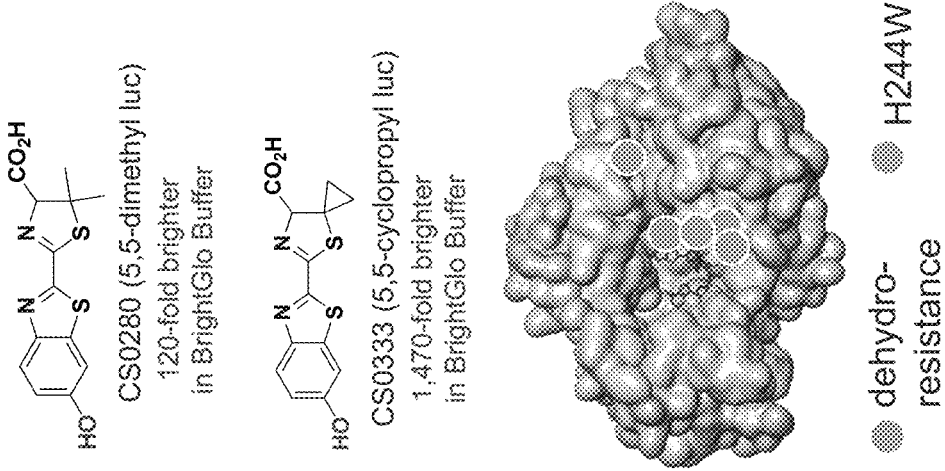
FIG. 9C

| Buffer | BrightGlo | Detection Reagent | BrightGlo | Detection Reagent | BrightGlo | Detection Reagent | BrightGlo | Detection Reagent |
|---|---|---|---|---|---|---|---|---|
| Substrate | D/L luciferin | D/L luciferin | CS0280 | CS0280 | CS0333 | CS0333 | CS0510 | CS0510 |
| Ppe variant | | | | | | | | |
| ATG2889 | 7,222,960 | 395,995 | 495,387 | 24,210 | 825,755 | 491,249 | 21,882 | 7,923 |
| C7958B7 | 7,314,930 | 1,717,850 | 1,094 | 136 | 358 | 336 | 1,246 | 759 |
| C7960A4 | 4,929,210 | 1,510,200 | 311,959 | 19,157 | 375,735 | 322,919 | 12,585 | 6,260 |
| C7969C5 | 2,942,160 | 659,142 | 500,241 | 21,577 | 1,638,760 | 1,007,070 | 15,549 | 6,218 |
| C7973B11 | 2,179,250 | 870,846 | 643,059 | 57,350 | 315,431 | 419,527 | 12,097 | 7,885 |
| C7973C2 | 2,659,490 | 883,896 | 361,556 | 30,432 | 308,981 | 344,142 | 14,964 | 7,276 |
| C7974E11 | 4,931,570 | 1,077,620 | 399,006 | 19,004 | 629,634 | 406,548 | 14,401 | 5,089 |
| C7975C11 | 2,538,000 | 910,443 | 759,365 | 44,471 | 593,313 | 452,334 | 12,225 | 5,231 |
| C7977D9 | 1,846,580 | 511,090 | 262,177 | 25,413 | 170,122 | 254,829 | 7,527 | 3,140 |
| C8013C4 | 3,007,380 | 664,820 | 391,989 | 17,263 | 1,361,140 | 873,915 | 17,981 | 5,631 |
| C8013D6 | 3,443,440 | 763,815 | 477,628 | 20,014 | 1,558,010 | 973,320 | 23,351 | 6,750 |
| C8031H12 | 880,945 | 1,116,730 | 186,279 | 24,834 | 27,618 | 83,259 | 3,184 | 5,173 |
| C5516F7 | 747,658 | 199,678 | 102,904 | 10,651 | 62,773 | 97,510 | 2,982 | 1,424 |
| C5517D10 | 1,186,160 | 303,495 | 154,472 | 13,815 | 101,156 | 151,323 | 4,183 | 2,050 |
| C5530D2 | 3,297,740 | 690,212 | 267,799 | 12,345 | 750,045 | 482,431 | 14,411 | 4,801 |
| C3391A4 | 2,236,900 | 733,307 | 219,472 | 14,391 | 191,921 | 153,239 | 10,309 | 4,049 |
| C3395H1 | 5,693,490 | 1,273,840 | 424,719 | 20,337 | 1,026,730 | 634,773 | 25,664 | 8,071 |
| C5156A11 | 5,381,260 | 1,354,940 | 461,410 | 28,669 | 556,437 | 447,947 | 17,025 | 6,478 |
| C5156D9 | 4,303,710 | 920,022 | 281,829 | 13,294 | 612,005 | 356,342 | 12,986 | 5,305 |
| | 4,154,650 | 960,321 | 318,877 | 18,491 | 423,417 | 309,662 | 12,003 | 4,993 |

FIG. 12A

ATG2889
H244W+T344A+I396K

ATG3552
H244W+T344A+I396K+V300G+L305P+S306P epPCR Mutants Rnd 1 – Shuffling hits

C4582F2 (P1B4)
H244W+T344A+I396K+S193A+N228D+L305F

C4583A3 (P1B6)
H244W+T344A+I396K+N228D+V297I

C4584D7 (P1B10)
H244W+T344A+I396K+N228D+V300G+L305F

C4599F7 (P1D12)
H244W+T344A+I396K+I214L+V262A+L305F+V335G

C4615B7 (P1F11)
H244W+T344A+I396K+N228D+L305F

| Ppe variant | D/L-luciferin | BrightGlo | |
| --- | --- | --- | --- |
| | | CS0333 | CS0579 |
| ATG2889 | 2,917,240 | 124 | 758 |
| ATG3552 | 3,785,500 | 855,629 | 528,187 |
| P1A6 | 837,803 | 1,141,110 | 265,056 |
| P1B4 | 537,573 | 743,836 | 305,010 |
| P1B6 | 781,675 | 1,509,350 | 291,071 |
| P1B10 | 748,295 | 1,421,260 | 269,673 |
| P1D12 | 834,179 | 1,467,810 | 240,910 |
| P1G7 | 1,082,760 | 1,448,290 | 223,402 |
| P1F11 | 380,996 | 605,845 | 362,775 |
| P1E9 | 792,325 | 1,385,080 | 230,586 |
| | 848,955 | 1,229,310 | 526,340 |

FIG. 12B

| Enzyme | Buffer | Substrate | Vmax (RLU) | Km (uM) |
|---|---|---|---|---|
| Ppe variant | BrightGlo | OH-luciferin | 14,221,184 | 0.26 |
| | | CS0333-02 | - | - |
| | | CS0333-02-Na | - | - |
| | Detection Reagent | OH-luciferin | 10,665,468 | 2.73 |
| | | CS0333-02 | - | - |
| | | CS0333-02-Na | - | - |
| ATG2889 (H244W, T344A, I396K) | BrightGlo | OH-luciferin | 11,221,775 | 0.18 |
| | | CS0333-02 | 485,273 | 1.37 |
| | | CS0333-02-Na | 474,941 | 1.17 |
| | Detection Reagent | OH-luciferin | 10,642,472 | 1.50 |
| | | CS0333-02 | 247,917 | 24.60 |
| | | CS0333-02-Na | 281,010 | 29.23 |

FIG. 16B

| | | | D/L Luciferin | | | CS833 | | |
|---|---|---|---|---|---|---|---|---|
| Enzyme | Mutations | Vmax (RLU) | Km (μM) | λmax (nm) | Vmax (RLU) | Km (μM) | λmax (nm) | |
| BrightGlo | | | | | | | | |
| Ppe variant | - | 2.8 x 10⁷ | 1.04 | 557 | - | - | - | |
| ATG2889 | H244W+T344A+I396K | 2.4 x 10⁷ | 0.57 | 577 | 1.0 x 10⁶ | 2.53 | 588 | |
| ATG3552 | H244W+T344A+I396K +V368S+L305F+S36P | 7.0 x 10⁶ | 0.49 | 595 | 1.8 x 10⁶ | 6.25 | 598 | |
| P1B10 | H244W+T344A+I396K | 1.4 x 10⁶ | 0.72 | 601 | 1.9 x 10⁶ | 4.45 | 601 | |
| Detection Reagent | | | | | | | | |
| Ppe variant | - | 1.7 x 10⁷ | 34.80 | " | - | - | " | |
| ATG2889 | H244W+T344A+I396K | 2.3 x 10⁷ | 12.27 | " | 5.6 x 10⁵ | 53.21 | " | |
| ATG3552 | H244W+T344A+I396K +V368S+L305F+S36P | 7.2 x 10⁶ | 15.20 | " | 8.1 x 10⁵ | 109.00 | " | |
| P1B10 | H244W+T344A+I396K | 2.0 x 10⁶ | 1.87 | " | 1.7 x 10⁶ | 124.80 | " | |

FIG. 17

| Enzyme | Vmax | Km | Mutation |
|---|---|---|---|
| ATG3674 | 2,970,726 | 83.6 | - |
| ATG3707 | 3,953,959 | 92.5 | I109V |
| ATG3708 | 2,949,208 | 106.9 | Q133H |
| ATG3709 | 3,702,699 | 109.0 | I214L |
| ATG3710 | 2,856,901 | 95.3 | F218L |
| ATG3711 | 2,639,721 | 86.5 | T233S |
| ATG3712 | 2,575,344 | 99.4 | S234T |
| ATG3713 | 2,770,316 | 112.4 | I236V |
| ATG3715 | 3,269,237 | 132.8 | V335G |
| ATG3714 | 2,818,942 | 84.68 | V262A |
| ATG3716 | 2,143,434 | 89.03 | S503R |
| ATG3717 | 1,438,591 | 83.18 | I214L+F218L |
| ATG3718 | 2,052,508 | 114.6 | T233S+S234T |
| ATG3719 | 1,711,138 | 121.8 | S234T+I236V |
| ATG3720 | 2,376,830 | 138.2 | T233S+I236V |

FIG. 19A

| Enzyme | Mutations | D/L-luciferin | | | CS0333 | | |
|---|---|---|---|---|---|---|---|
| | | Vmax (RLU) | Km (μM) | λmax (nm) | Vmax (RLU) | Km (μM) | λmax (nm) |
| Ppe variant | - | 2.8 x 10⁷ | 1.04 | 557 | - | - | - |
| ATG2889 | H244W+T344A+I396K | 2.4 x 10⁷ | 0.57 | 577 | 1.0 x 10⁶ | 2.53 | 588 |
| ATG3552 | H244W+T344A+I396K +V300G+L305F+S306P | 7.0 x 10⁶ | 0.49 | 595 | 1.8 x 10⁶ | 6.25 | 598 |
| C4584D7 (P1B10) | H244W+T344A+I396K +V300G+L305F+N228D | 1.4 x 10⁶ | 0.72 | 601 | 1.9 x 10⁶ | 4.45 | 601 |
| ATG3707 | H244W+T344A+I396K+S 193A+N228D+L305F +S306P+I109V | 1.2 x 10⁶ | 0.03 | 600 | 4.2 x 10⁶ | 4.44 | 600 |

FIG. 19D

| Buffer | Ppe variant | ATG2624 | ATG2625 |
|---|---|---|---|
| BrightGlo | $1.9 \times 10^{-5}$ | 0.0582 | 0.188 |
| Detection Reagent | 0.0878 | 0.522 | 0.894 |

FIG. 20C

Calculated IC50 values (in uM), log[inhibitor] vs normalized luminescence

BrightGlo buffer, fixed ATG2890 data

| Buffer | Ppe variant | ATG2624 | ATG2877 | ATG2890 |
|---|---|---|---|---|
| BrightGlo | 0.202 | 0.731 | 0.300 | 0.138 |
| Detection Reagent | 0.642 | 3.86 | 0.419 | 0.325 |

FIG. 21C

Calculated IC50 values (in uM), log[inhibitor] vs normalized luminescence

Conclusion: The IC50 for the variants ATG2877 and ATG2890 shows they were not as resistant to dehydro F-luciferin as the ATG2624 mutations alone relative to Ppe variant

| | Enzyme | Ppe variant | Ppe variant | ATG2889 | ATG2889 | ATG2889 | ATG3552 | ATG3553 | ATG3554 | |
|---|---|---|---|---|---|---|---|---|---|---|
| | Substrate | D/L-luciferin | F-luciferin | D/L-luciferin | F-luciferin | CS0333 | CS0333 | D/L-luciferin | F-luciferin | Ki (uM) |
| Competitor | CS0565-1 | 2.08 | - | 5.6 | - | 126.6 | - | - | - | |
| | CS0565-2 | 15.22 | - | 7.48 | - | 67.2 | - | - | - | |
| | CS0565-3 | 3.89 | - | 0.143 | - | 1.16 | - | - | - | |
| | CS0565-4 | 1.1 | - | 0.274 | - | 2.79 | 0.26 | - | - | |
| | dehydro-F-luciferin | - | 0.033 | - | 0.031 | - | 0.26 | - | 0.044 | |
| | dehydro-OH-luciferin | 0.013 | - | 0.0096 | - | 0.072 | - | 0.11 | - | |

ATG2889 = H244W+T344A+I396K

ATG3552 = H244W+T344A+I396K+V300G+L305F+S306P

FIG. 25

| | IC50 (nM) | |
|---|---|---|
| | BrightGlo | Detection Reagent |
| Ppe variant | 39.9 | 419.7 |
| ATG2889 | 71.8 | 562.5 |
| ATG3550 | 67.8 | 540.0 |
| ATG3551 | 110.6 | 633.3 |
| ATG3552 | 95.8 | 794.8 |
| ATG3553 | 118.0 | 623.6 | epPCR mutants Rnd 1 – Combinatorial analysis

ATG3550
H244W+T344A+I396K+V300G+L305F

ATG3551
H244W+T344A+I396K+V300G+L305P

ATG3552
H244W+T344A+I396K+V300G+L305P+S306P

ATG3553
H244W+T344A+I396K+L305P+S306P

FIG. 26

Variants exhibiting improved activity with CS0280 and CS0333

| Enzyme | Fold-improvement over ATG3707 | | | | DSF Tm |
|---|---|---|---|---|---|
| | CS0333 | | CS0280 | | |
| | DR | BG | DR | BG | |
| C7612E10 | 2.27 | 2.28 | 2.02 | 2.22 | 63 |
| C7573G10 | 2.09 | 2.81 | 19.49 | 14.12 | 62 |
| C7573H3 | 3.36 | 4.35 | 7.48 | 6.04 | 61 |
| C7579E3 | 1.96 | 1.19 | 3.63 | 3.26 | 55 |
| C7582A5 | 1.45 | 1.35 | 1.02 | 1.10 | 58 |
| C7584F2 | 2.15 | 2.35 | 2.68 | 2.78 | 65 |
| C2240E2 | 1.21 | 1.26 | 1.39 | 1.24 | 49 |
| C2261D9 | 1.43 | 1.10 | 1.89 | 1.39 | 61 |
| C2242E1 | 1.63 | 1.75 | 1.56 | 1.25 | 54 |
| C2260B6 | 1.00 | 0.70 | 0.97 | 0.82 | 55 |
| C2158A3 | 1.15 | 0.92 | 1.49 | 1.30 | 61 |
| C2261D1 | 1.24 | 1.27 | 2.41 | 2.02 | 54 |
| C2157D2 | 1.52 | 1.16 | 3.08 | 2.36 | 63 |

FIG. 30

LUCIFERASE ENZYMES FOR USE WITH THERMOSTABLE LUCIFERINS IN BIOLUMINESCENT ASSAYS

CROSS REFERENCE TO RELATED APPLICATIONS

The present application claims priority to and the benefit of U.S. Provisional Patent Application No. 62/680,899, filed Jun. 5, 2018, which is incorporated herein by reference in its entirety and for all purposes.

FIELD

Provided herein are enhanced luciferase enzyme variants for use with thermostable luciferin analogs for bioluminescent assays. In particular, the present disclosure provides compositions, assays, and methods for performing a bioluminescent assay using enhanced, high-activity luciferase enzymes compatible with thermostable luciferins, such as 5,5-disubstituted luciferin analogs.

BACKGROUND

Bioluminescent assays are used extensively in the investigation of cellular physiology, gene expression, protein-protein interactions, and analyte detection. In particular, luciferase reporter enzymes are quite valuable tools in this field, and, to date, there has been intense protein engineering to obtain small, robust, stable, and environmentally insensitive luciferases that may be useful in bioluminescent assays. There exist a number of efficient luciferase reporters that facilitate whole-cell biosensor measurements, drug discovery through high-throughput screening, and in vivo imaging that also permit the study of protein-protein interactions in living cells, apoptosis, and cell viability. Luciferases that use luciferin and luciferin analogues as substrates are widely used systems due to their brightness and acceptance in whole cell applications. Firefly luciferase and various beetle luciferases, for example, produce luminescence in the presence of luciferin, magnesium ions, oxygen, and ATP. However, current luciferin-based bioluminescence reagents are limited by their thermal instability due to the racemization and breakdown of the luciferin substrate into products that can be inhibitory to the activity of luciferase. In particular, the breakdown of luciferin can result in the limitation of the performance and longevity of products and assays that utilize these reagents, particularly in formats in which components are stored as liquids and/or at ambient temperatures.

SUMMARY

Provided herein are enhanced luciferase enzyme variants for use with thermostable luciferin analogs for bioluminescent assays. In particular, the present disclosure provides compositions, assays, and methods for performing a bioluminescent assay using enhanced, high-activity luciferase enzyme variants compatible with thermostable luciferins such as 5,5-disubstituted luciferin analogs.

Embodiments of the present disclosure include a luciferase enzyme variant polypeptide capable of producing an increased bioluminescent signal in the presence of a 5,5-disubstituted luciferin analog compared to a bioluminescent signal produced by a thermostable luciferase variant of *Photuris pennsylvanica* (Ppe) of SEQ ID NO: 1 in the presence of the 5,5-disubstituted luciferin analog, wherein the luciferase enzyme variant polypeptide is not naturally occurring. In some embodiments, the luciferase enzyme variant polypeptide comprises at least 70% sequence identity with SEQ ID NO: 2 and less than 100% sequence identity with SEQ ID NO: 1.

In some embodiments, the luciferase enzyme variant polypeptide comprises at least one amino acid substitution at positions 244, 249, 337, and 339, relative to SEQ ID NO: 1. In some embodiments, the at least one amino acid substitution is selected from H244W, H244G, and H244R, and/or any conservative or semi-conservative variations of the at least one amino acid substitution. In some embodiments, the luciferase enzyme variant polypeptide comprises at least one amino acid substitution at positions 240, 254, and 344, relative to SEQ ID NO: 1. In some embodiments, the at least one amino acid substitution is selected from I240L, Y254S, and T344A, and/or any conservative or semi-conservative variations of the at least one amino acid substitution. In some embodiments, the luciferase enzyme variant polypeptide comprises at least one amino acid substitution at positions 300 and 396 relative to SEQ ID NO: 1. In some embodiments, the at least one amino acid substitution is selected from V300G and I396K, and/or any conservative or semi-conservative variations of the at least one amino acid substitution. In some embodiments, the luciferase enzyme variant polypeptide comprises at least one amino acid substitution at positions 245, 285, and 315 relative to SEQ ID NO: 1. In some embodiments, the at least one amino acid substitution is selected from G245A, L285I, and G315A, and/or any conservative or semi-conservative variations of the at least one amino acid substitution. In some embodiments, the luciferase enzyme variant polypeptide comprises at least one amino acid substitution at positions 109, 193, 214, 218, 228, 234, 262, 287, 294, 305, 306, 309, 316, 335, and 533 relative to SEQ ID NO: 1. In some embodiments, the at least one amino acid substitution is selected from I109V, S193A, I214L, F218L, N228D, S234T, V262A, V287I, L294H, L305F, S306P, K309E, A316S, V335G, and/or V553M, and/or any conservative or semi-conservative variations of the at least one amino acid substitution. In some embodiments, the luciferase enzyme variant polypeptide comprises at least one amino acid substitution at positions 133, 233, 236, and 503, relative to SEQ ID NO: 1. In some embodiments, the at least one amino acid substitution is selected from Q133H, T233S, I236V, and/or S503R and/or any conservative or semi-conservative variations of the at least one amino acid substitution. In some embodiments, the luciferase enzyme variant polypeptide comprises at least one amino acid substitution at positions 107 and 121 relative to SEQ ID NO: 1. In some embodiments, the at least one amino acid substitution is selected from K107Q and/or K121N and/or any conservative or semi-conservative variations of the at least one amino acid substitution. In some embodiments, the luciferase enzyme variant polypeptide comprises the amino acid substitutions in any one of SEQ ID NOs: 2-124 listed in Table 1.

In some embodiments, one or more of the luciferase enzyme variant polypeptides described above are resistant to inhibition by dehydroluciferin and derivatives thereof compared to inhibition of the luciferase polypeptide of SEQ ID NO: 1 by the dehydroluciferin and derivatives thereof. In some embodiments, the bioluminescent signal produced by the luciferase enzyme variant polypeptide is increased at least 10-fold compared to the bioluminescent signal produced by the luciferase polypeptide of SEQ ID NO: 1.

In some embodiments, the luciferase enzyme variant polypeptide comprises amino acid substitutions I240L, Y254S, T344A, and I396K relative to SEQ ID NO: 1 and/or any conservative or semi-conservative variations of the amino acid substitutions. In some embodiments, the luciferase enzyme variant polypeptide comprises amino acid substitutions N74N, H244R, V300G, and I396K relative to SEQ ID NO: 1 and/or any conservative or semi-conservative variations of the amino acid substitutions. In some embodiments, the luciferase enzyme variant polypeptide comprises amino acid substitution H244W relative to SEQ ID NO: 1 and/or any conservative or semi-conservative variations of the amino acid substitution. In some embodiments, the luciferase enzyme variant polypeptide comprises amino acid substitutions H244W, Y254S, T344A, and I396K relative to SEQ ID NO: 1 and/or any conservative or semi-conservative variations of the amino acid substitutions. In some embodiments, the luciferase enzyme variant polypeptide comprises amino acid substitutions H244W, T344A, and I396K relative to SEQ ID NO: 1 and/or any conservative or semi-conservative variations of the amino acid substitutions.

In some embodiments, the luciferase enzyme variant polypeptide comprises amino acid substitutions H244W, T344A, I396K, V300G, L305P, and S306P relative to SEQ ID NO: 1 and/or any conservative or semi-conservative variations of the amino acid substitutions. In some embodiments, the luciferase enzyme variant polypeptide comprises amino acid substitutions H244W, T344A, I396K, S193A, N228D, L305F, S306P, and I109V relative to SEQ ID NO: 1 and/or any conservative or semi-conservative variations of the amino acid substitutions. In some embodiments, the luciferase enzyme variant polypeptide comprises amino acid substitutions H244W, Y254S, T344A, S193A, N228D, L305F, S306P, I109V, I230F, V335G, and I410M relative to SEQ ID NO: 1 and/or any conservative or semi-conservative variations of the amino acid substitutions. In some embodiments, the luciferase enzyme variant polypeptide comprises amino acid substitutions H244W, Y254S, T344A, S193A, N228D, L305F, S306P, I109V, C38S, Y108F, and T376I relative to SEQ ID NO: 1 and/or any conservative or semi-conservative variations of the amino acid substitutions.

In some embodiments, the luciferase enzyme variant polypeptide comprises amino acid substitutions H244W, Y254S, T344A, S193A, N228D, L305F, S306P, I109V, C38S, F55I, V262A, and I422V relative to SEQ ID NO: 1 and/or any conservative or semi-conservative variations of the amino acid substitutions. In some embodiments, the luciferase enzyme variant polypeptide comprises amino acid substitutions H244W, Y254S, T344A, S193A, N228D, L305F, S306P, I109V, Y108F, V261A, N427D, and F431V relative to SEQ ID NO: 1 and/or any conservative or semi-conservative variations of the amino acid substitutions. In some embodiments, the luciferase enzyme variant polypeptide comprises amino acid substitutions H244W, Y254S, T344A, S193A, N228D, L305F, S306P, I109V, and I230F relative to SEQ ID NO: 1 and/or any conservative or semi-conservative variations of the amino acid substitutions. In some embodiments, the luciferase enzyme variant polypeptide comprises amino acid substitutions H244W, Y254S, T344A, S193A, N228D, L305F, S306P, I109V, and Q487R relative to SEQ ID NO: 1 and/or any conservative or semi-conservative variations of the amino acid substitutions.

In some embodiments, the luciferase enzyme variant polypeptide comprises amino acid substitutions H244W, Y254S, T344A, S193A, N228D, L305F, S306P, I109V, N154S, V261A, and I410M relative to SEQ ID NO: 1 and/or any conservative or semi-conservative variations of the amino acid substitutions. In some embodiments, the luciferase enzyme variant polypeptide comprises amino acid substitutions H244W, Y254S, T344A, S193A, N228D, L305F, S306P, I109V, Y183C, V261A, and T289S relative to SEQ ID NO: 1 and/or any conservative or semi-conservative variations of the amino acid substitutions. In some embodiments, the luciferase enzyme variant polypeptide comprises amino acid substitutions H244W, Y254S, T344A, S193A, N228D, L305F, S306P, I109V, and Y32C relative to SEQ ID NO: 1 and/or any conservative or semi-conservative variations of the amino acid substitutions. In some embodiments, the luciferase enzyme variant polypeptide comprises amino acid substitutions H244W, Y254S, T344A, S193A, N228D, L305F, S306P, I109V, F246Y, and V261A relative to SEQ ID NO: 1 and/or any conservative or semi-conservative variations of the amino acid substitutions. In some embodiments, the luciferase enzyme variant polypeptide comprises amino acid substitutions H244W, Y254S, T344A, S193A, N228D, L305F, S306P, I109V, and I230F relative to SEQ ID NO: 1 and/or any conservative or semi-conservative variations of the amino acid substitutions.

In some embodiments, the luciferase enzyme variant polypeptide comprises amino acid substitutions H244W, Y254S, T344A, S193A, N228D, L305F, S306P, I109V, K121Q, F246Y, and V261A relative to SEQ ID NO: 1 and/or any conservative or semi-conservative variations of the amino acid substitutions. In some embodiments, the luciferase enzyme variant polypeptide comprises amino acid substitutions H244W, Y254S, T344A, S193A, N228D, L305F, S306P, I109V, K121Q, V261A, and V287I relative to SEQ ID NO: 1 and/or any conservative or semi-conservative variations of the amino acid substitutions. In some embodiments, the luciferase enzyme variant polypeptide comprises at least one additional amino acid substitutions selected from the group consisting of: V348I, A316M, A316W, Y339M, T342S, A344I, K121Q, V261A, V287I, K107N, and T289S, relative to SEQ ID NO: 1, and/or any conservative or semi-conservative variations of the amino acid substitutions.

In some embodiments, the luciferase enzyme variant polypeptide comprises amino acid substitution A316W, relative to SEQ ID NO: 1, and/or any conservative or semi-conservative variations of the amino acid substitution. In some embodiments, the luciferase enzyme variant polypeptide comprises at least one additional amino acid substitutions selected from the group consisting of: C38R, F55I, A316W, T342S, V348I, K205N, I396I, K121Q, Y339M, T344I, and Y108F, relative to SEQ ID NO: 1, and/or any conservative or semi-conservative variations of the amino acid substitutions. In some embodiments, the luciferase enzyme variant polypeptide comprises amino acid substitutions C38R, F55I, A316W, T342S, and V348I, relative to SEQ ID NO: 1, and/or any conservative or semi-conservative variations of the amino acid substitutions. In some embodiments, the luciferase enzyme variant polypeptide comprises amino acid substitutions C38R, F55I, Y108F, A316W, Y339M, and T344I, relative to SEQ ID NO: 1, and/or any conservative or semi-conservative variations of the amino acid substitutions.

In some embodiments, the luciferase enzyme variant polypeptide comprises at least one additional amino acid substitutions selected from the group consisting of: T344I, C38R, F55I, A316W, T342S, V348I, Y108F, Y339M, I240V, T284A, T289R, T289S, K353R, D435G, L437R, W510R, C257R, and S313T, relative to SEQ ID NO: 1, and/or any conservative or semi-conservative variations of the amino acid substitutions. In some embodiments, the luciferase enzyme variant polypeptide comprises amino acid substitutions H244W, T344I, I396K, S193A, N228D, L305F, S306P, I109V, C38R, F55I, A316W, T342S, and V348I, relative to SEQ ID NO: 1, and/or any conservative or semi-conservative variations of the amino acid substitutions. In some embodiments, the luciferase enzyme variant polypeptide comprises amino acid substitutions C38R, F55I, Y108F, A316W, and Y339M relative to SEQ ID NO: 1 and/or any conservative or semi-conservative variations of the amino acid substitutions. In some embodiments, the luciferase enzyme variant polypeptide comprises amino acid substitutions H244W, S193A, N228D, L305F, S306P, I109V, C38R, F55I, A316W, T342S, and V348I relative to SEQ ID NO: 1 and/or any conservative or semi-conservative variations of the amino acid substitutions.

In some embodiments, the luciferase enzyme variant polypeptide comprises amino acid substitutions H244W, S193A, N228D, L305F, S306P, I109V, C38R, F55I, Y108F, A316W, Y339M, T342S, and V348I, relative to SEQ ID NO: 1, and/or any conservative or semi-conservative variations of the amino acid substitutions. In some embodiments, the luciferase enzyme variant polypeptide comprises amino acid substitutions H244W, S193A, N228D, L305F, S306P, I109V, C38R, F55I, Y108F, A316W, Y339M, T342S, V348I, T289S, K353R, D435G, and W510R relative to SEQ ID NO: 1 and/or any conservative or semi-conservative variations of the amino acid substitutions. In some embodiments, the luciferase enzyme variant polypeptide comprises amino acid substitutions H244W, S193A, N228D, L305F, S306P, I109V, C38R, F55I, Y108F, A316W, Y339M, T342S, V348I, C257R, T284A, T289S, S313T, K353R, D435G, L437R, and W510R relative to SEQ ID NO: 1 and/or any conservative or semi-conservative variations of the amino acid substitutions.

Provided herein are compositions and methods for performing a bioluminescent assay. In accordance with these embodiments, the composition includes a luciferase enzyme variant polypeptide capable of producing an increased bioluminescent signal in the presence of a 5,5-disubstituted luciferin analog compared to a bioluminescent signal produced by a luciferase polypeptide of SEQ ID NO: 1 in the presence of the 5,5-disubstituted luciferin analog and a substrate for the luciferase polypeptide. In some embodiments, the substrate is racemic luciferin. In some embodiments, the substrate is a luciferin analog. In some embodiments, the luciferin analog is a 5,5-disubstituted luciferin analog. In some embodiments, the composition further comprises magnesium. In some embodiments, the composition further comprises one or more additional components selected from the group consisting of: a buffer, a defoamer, an ATPase inhibitor, L-luciferin, azathiothymine (ATT), an enzyme stabilizer, a detergent, an inhibitor of ATP-generating enzymes, a cell lysing agent, an ATP-extraction agent, co-enzyme A, a thiol reagent, a metal ion chelator, a protease inhibitor, pyrophosphate, sodium fluoride, dehydroluciferin, and a salt. In some embodiments, the reagent composition is a single liquid reagent. In some embodiments, the reagent composition is a single dried reagent. In some embodiments, the composition comprises a solid component and a liquid component.

Provided herein are kits comprising any of the reagent compositions described above. In some embodiments, the kit comprises instructions for performing a bioluminescent assay. In some embodiments, the bioluminescent assay measures/detects caspase activity, kinase activity, a CYP450 enzyme activity, reactive oxygen species, nucleotide detection or quantification, cell viability, cytotoxicity, or hydrogen peroxide detection or quantification.

Provided herein are kits comprising a luciferase enzyme variant polypeptide capable of producing an increased bioluminescent signal in the presence of a 5,5-disubstituted luciferin analog compared to a bioluminescent signal produced by a luciferase polypeptide of SEQ ID NO: 1 in the presence of the 5,5-di substituted luciferin analog and a substrate for the luciferase polypeptide.

Provided herein are assay systems for detecting or quantifying ATP in a sample comprising a reagent composition comprising a luciferase enzyme variant polypeptide capable of producing an increased bioluminescent signal in the presence of a 5,5-disubstituted luciferin analog compared to a bioluminescent signal produced by a luciferase polypeptide of SEQ ID NO: 1 in the presence of the 5,5-disubstituted luciferin analog, a substrate for the luciferase polypeptide, and a sample comprising or suspected of comprising ATP. In some embodiments, the assay system further comprises a device for the detection and or measurement of bioluminescence. In some embodiments, the sample is one or more of a cell lysate sample, a cell-free preparation sample, or a purified enzyme formulation sample. In some embodiments, the sample is one or more of an environmental sample, a soil sample, a water sample, an industrial chemical sample, a forensic sample, a food-based sample, a liquid sample, a beverage-based sample, or a biochemical sample.

Provided herein are methods of detecting or quantifying ATP in a sample using any of the assay systems described above. In some embodiments, the assay is performed on a sample comprising or suspected of comprising ATP and includes detecting or quantifying the bioluminescent signal.

Provided herein are assay systems for detecting or quantifying target enzyme activity in a sample. In accordance with these embodiments, the assay system includes a reagent composition comprising a luciferase enzyme variant polypeptide capable of producing an increased bioluminescent signal in the presence of a 5,5-disubstituted luciferin analog compared to a bioluminescent signal produced by a luciferase polypeptide of SEQ ID NO: 1 in the presence of the 5,5-disubstituted luciferin analog, a substrate for the luciferase polypeptide, and a sample comprising or suspected of comprising a target enzyme. In some embodiments, the 5,5-disubstituted luciferin analog is conjugated to a substrate of the target enzyme. In some embodiments, the target enzyme is a protease, a caspase, a kinase, a cytochrome 450 (CYP450), a DNA polymerase, an RNA polymerase, or a monoamine oxidase. In some embodiments, the assay further comprises a device for the detection and or measurement of bioluminescence. In some embodiments, the sample is a cell lysate. In some embodiments, the sample is an environmental, industrial, forensic, food-based, or biochemical sample.

Provided herein are methods of detecting or quantifying target enzyme activity in a sample. In accordance with these embodiments, the method includes adding any of the assay systems described above to the sample comprising or suspected of comprising target enzyme activity and detecting or quantifying the bioluminescent signal.

BRIEF DESCRIPTION OF THE DRAWINGS

FIGS. 2A-2C include representative schematic diagrams depicting the relationships among the luciferase polypeptides of the present disclosure based on their amino acid substitutions relative to a thermostable variant of Ppe (SEQ ID NO: 1; ATG-2287).

FIG. 4 includes representative images of the active site of the luciferase of SEQ ID NO: 1 (left), a table containing various amino acid substitutions at the positions indicated (middle), and a graph indicating the activity levels of each of the variants tested using racemic luciferin as a substrate (right).

FIG. 7 includes a representative graph assessing the activities of luciferase enzyme variants with amino acid substitutions at positions 244 and 339 of SEQ ID NO: 1 in the presence of 5,5-disubstituted luciferin analog substrate.

FIGS. 9A-9D include representative graphs assessing the activities of luciferase enzyme variants ATG-2877, ATG-2624, and ATG-2890 in the presence of 5,5-disubstituted luciferin analog substrate.

FIGS. 12A-12B include representative results of activity tests of various luciferase enzyme variants identified with epPCR and DNA Shuffling with 5,5-di substituted luciferin analogs.

FIGS. 16A-16B include representative results of kinetic analysis of a thermostable luciferase variant of Ppe (SEQ ID NO: 1) with luciferin and the ATG-2889 variant with CS0333 in two buffer compositions.

FIG. 17 includes representative results of kinetic analysis of a thermostable luciferase variant of Ppe variant of SEQ ID NO: 1, ATG-2889, ATG-3552, and C4584D7 (P1B10) enzymes with luciferin and CS0333 in two buffer compositions.

FIGS. 19A-19E include representative results of activity data and kinetic analysis of various luciferase enzyme variants identified using epPCR with, FIGS. 19B-19E highlighting the enhanced activity of variant ATG-3707 with the CS0333 substrate.

FIGS. 20A-20C include graphs of luminescence of various luciferase enzyme variants in the presence of increasing dehydroluciferin concentration and (FIG. 20A) Detection reagent buffer, or (FIG. 20B) Bright-Glo™ buffer; and (FIG. 20C) a table depicting IC50 values (µM) derived therefrom.

FIG. 25 includes a summary of Ki values for a thermostable luciferase variant of Ppe (SEQ ID NO: 1), ATG-2889, and ATG-3552 in the presence of CS0333 and its breakdown products.

FIG. 26 includes IC50 values for luciferase enzyme variants comprising amino acid substitution V300G in the presence of dehydro F-luciferin.

FIG. 30 includes representative activity data (fold improvement over ATG-3707) for various luciferase enzyme variants with either the CS0333 or CS0280 substrate.

DETAILED DESCRIPTION

Figure 1:
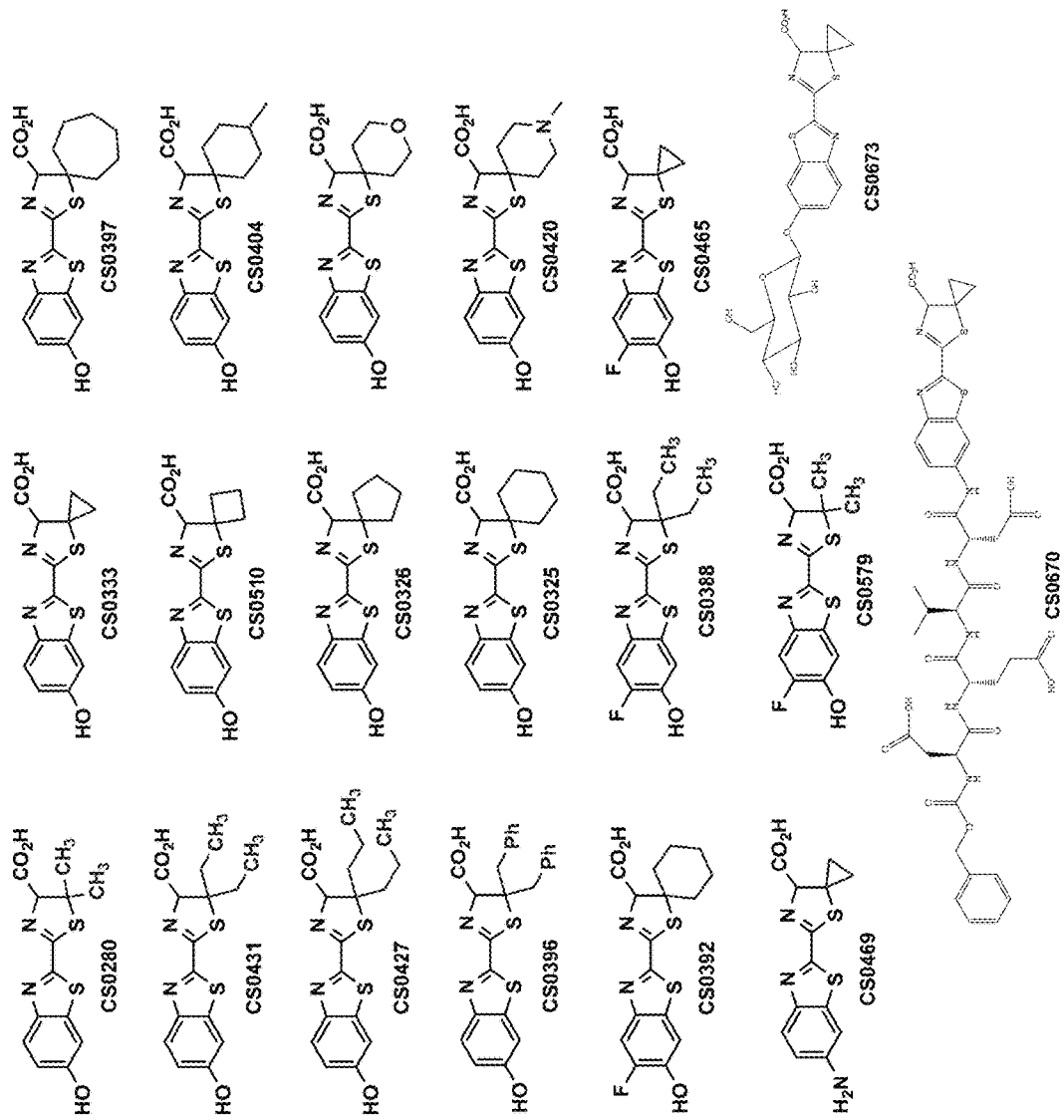
FIG. 1 includes representative structures of 5,5-disubstituted luciferin analogs.

Embodiments of the present disclosure include enhanced luciferase enzyme variants for use with thermostable luciferin analogs for bioluminescent assays. In particular, the present disclosure provides compositions, assays, and methods for performing a bioluminescent assay using enhanced, high-activity luciferase enzyme variants compatible with thermostable luciferins, such as 5,5-disubstituted luciferin analogs.

Current luciferin-based bioluminescence reagents are limited by their thermal instability due to the racemization and breakdown of the luciferin substrate into products that are inhibitory to the activity of luciferase. In particular, the breakdown of luciferin into dehydroluciferin has been shown to result in potent inhibition of luciferase enzymes (e.g., UltraGlo® luciferase; Promega Corporation) even at nanomolar levels. This breakdown ultimately limits the performance and longevity of products using these reagents, particularly under storage conditions, such as when components are stored as liquids and/or at ambient temperatures (or lower, non-frozen temperatures, or higher temperatures, etc.). Luciferin analogs have been created that do not breakdown to dehydroluciferin due to various chemical modifications. For example, luciferin analogs that incorporate modifications at the 5-position of luciferin have been developed to improve and enhance the stability of luciferin-containing bioluminescence reagents (e.g., 5,5-disubstituted luciferins and luciferin analogs as described in U.S. Pat. No. 10,400,264, which is herein incorporated by reference in its entirety and for all purposes). However, these luciferin analogs are poor substrates for many luciferase enzymes (Miller, S. C., et al. "Lessons Learned from Luminous Luciferins and Latent Luciferases." ACS Chem Biol. 2018 Feb. 19, which is herein incorporated by reference in its entirety), exhibiting very low or no bioluminescence and, in some cases, competitive inhibition of luciferase enzymes for its natural substrate (luciferin).

Section headings as used in this section and the entire disclosure herein are merely for organizational purposes and are not intended to be limiting.

Definitions

Unless otherwise defined, all technical and scientific terms used herein have the same meaning as commonly understood by one of ordinary skill in the art. In case of conflict, the present document, including definitions, will control. Preferred methods and materials are described below, although methods and materials similar or equivalent to those described herein can be used in practice or testing of the present disclosure. All publications, patent applications, patents and other references mentioned herein are incorporated by reference in their entirety. The materials, methods, and examples disclosed herein are illustrative only and not intended to be limiting.

The terms "comprise(s)," "include(s)," "having," "has," "can," "contain(s)," and variants thereof, as used herein, are intended to be open-ended transitional phrases, terms, or words that do not preclude the possibility of additional acts or structures. The singular forms "a," "and" and "the" include plural references unless the context clearly dictates otherwise. Many embodiments herein are described using open "comprising" language. Such embodiments encompass multiple closed "consisting of" and/or "consisting essentially of" embodiments, which may alternatively be claimed or described using such language. The present disclosure also contemplates other embodiments "comprising," "consisting of" and "consisting essentially of," the embodiments or elements presented herein, whether explicitly set forth or not.

For the recitation of numeric ranges herein, each intervening number there between with the same degree of precision is explicitly contemplated. For example, for the range of 6-9, the numbers 7 and 8 are contemplated in addition to 6 and 9, and for the range 6.0-7.0, the number 6.0, 6.1, 6.2, 6.3, 6.4, 6.5, 6.6, 6.7, 6.8, 6.9, and 7.0 are explicitly contemplated.

"Amino acid" refers to natural amino acids, unnatural amino acids, and amino acid analogs, all in their D and L stereoisomers, unless otherwise indicated, if their structures allow such stereoisomeric forms.

Natural amino acids include alanine (Ala or A), arginine (Arg or R), asparagine (Asn or N), aspartic acid (Asp or D), cysteine (Cys or C), glutamine (Gln or Q), glutamic acid (Glu or E), glycine (Gly or G), histidine (His or H), isoleucine (Ile or I), leucine (Leu or L), Lysine (Lys or K), methionine (Met or M), phenylalanine (Phe or F), proline (Pro or P), serine (Ser or S), threonine (Thr or T), tryptophan (Trp or W), tyrosine (Tyr or Y), and valine (Val or V).

Unnatural amino acids include, but are not limited to, azetidinecarboxylic acid, 2-aminoadipic acid, 3-aminoadipic acid, beta-alanine, naphthylalanine ("naph"), aminopropionic acid, 2-aminobutyric acid, 4-aminobutyric acid, 6-aminocaproic acid, 2-aminoheptanoic acid, 2-aminoisobutyric acid, 3-aminoisbutyric acid, 2-aminopimelic acid, tertiary-butylglycine ("tBuG"), 2,4-diaminoisobutyric acid, desmosine, 2,2'-diaminopimelic acid, 2,3-diaminopropionic acid, N-ethylglycine, N-ethylasparagine, homoproline ("hPro" or "homoP"), hydroxylysine, allo-hydroxylysine, 3-hydroxyproline ("3Hyp"), 4-hydroxyproline ("4Hyp"), isodesmosine, allo-isoleucine, N-methylalanine ("MeAla" or "Nime"), N-alkylglycine ("NAG") including N-methylglycine, N-methylisoleucine, N-alkylpentylglycine ("NAPG") including N-methylpentylglycine. N-methylvaline, naphthylalanine, norvaline ("Norval"), norleucine ("Norleu"), octylglycine ("OctG"), ornithine ("Orn"), pentylglycine ("pG" or "PGly"), pipecolic acid, thioproline ("ThioP" or "tPro"), homoLysine ("hLys"), and homoArginine ("hArg").

"Amino acid analog" refers to a natural or unnatural amino acid where one or more of the C-terminal carboxy group, the N-terminal amino group and side-chain bioactive group has been chemically blocked, reversibly or irreversibly, or otherwise modified to another bioactive group. For example, aspartic acid-(beta-methyl ester) is an amino acid analog of aspartic acid; N-ethylglycine is an amino acid analog of glycine; or alanine carboxamide is an amino acid analog of alanine. Other amino acid analogs include methionine sulfoxide, methionine sulfone, S-(carboxymethyl)-cysteine, S-(carboxymethyl)-cysteine sulfoxide, and S-(carboxymethyl)-cysteine sulfone.

"Apparent signal stability" refers to the persistence of a signal (e.g., luminescence) from an enzyme (e.g., luciferase combined with luciferin and ATP) under a particular set of conditions (e.g., in the presence of an inhibitor). "Enhanced apparent signal stability" refers to an increase in the persistence of a signal (e.g., luminescent signal) from an enzyme (e.g., a luciferase) combined with luciferin and ATP under a particular set of conditions compared to the persistence of that same enzyme combined with luciferin and ATP under reference conditions. For example, a variant luciferase combined with luciferin and ATP may exhibit enhanced apparent signal stability in the presence of an inhibitor (e.g., by lowering the initial signal from the luciferase, the loss of signal over a time course is reduced). In some embodiments, a variant enzyme combined with luciferin and ATP exhibits "an increase in enhancement of apparent signal stability" when the variant luciferase combined with luciferin and ATP exhibits a greater enhancement of apparent signal stability compared to a reference luciferase (e.g., compared a reference luciferase such as SEQ ID NO: 1) combined with luciferin and ATP.

"Bioluminescence" refers to production and emission of light by a chemical reaction catalyzed by, or enabled by, an enzyme, protein, protein complex, or other biomolecule (e.g., bioluminescent complex). In typical embodiments, a substrate for a bioluminescent entity (e.g., bioluminescent protein or bioluminescent complex) is converted into an unstable form by the bioluminescent entity; the substrate subsequently emits light.

"Enhanced" refers to an improvement in a particular property relative to that of a reference. For example, when used to describe a property of a luciferase variant (e.g., luminescence, signal stability, biocompatibility, protein stability (e.g., enzyme stability), or protein expression), "enhanced" refers to an improvement (e.g., 1%, 2%, 5%, 10%, 20%, 25%, 50%, 75%, 2-fold, 3-fold, 4 fold, 5-fold, 10 fold, 20-fold, 50-fold, 100-fold, 200-fold, 500-fold, 1000-fold, or more, or ranges therebetween) in that property compared to a reference luciferase (such as SEQ ID NO: 1). A variant luciferase may exhibit one or more of "enhanced luminescence," "enhanced signal stability," "enhanced enzyme stability," "enhanced protein expression," etc. (e.g., SEQ ID NO: 2).

"Enhanced signal stability" refers to an increase in signal duration (e.g., the persistence of a signal intensity (e.g., luminescent signal) from an enzyme (e.g., a luciferase combined with luciferin and ATP) compared to a reference enzyme (e.g., SEQ ID NO: 1) combined with luciferin and ATP).

"Enzyme stability" refers to the capacity of an enzyme to remain active following exposure to a particular set of conditions (e.g., temperature, pH, ionic concentration, inhibitory agents, etc.). For example, an enzyme that exhibits enhanced stability relative to a control enzyme exhibits a smaller loss of activity upon exposure to a set of conditions than the control enzyme.

"Inhibitor resistant" and "enhanced resistance to inhibitor" refers to an enzyme that retains more activity in the presence of an inhibitor or enzyme activity than a reference version of the enzyme (e.g., a native wild-type version of the enzyme). An inhibitor-resistant enzyme is not necessarily 100% resistant to inhibitor. For example, an "inhibitor-resistant luciferase" is a polypeptide that retains more (e.g., exhibits a smaller percentage loss) luciferase activity (e.g., conversion of luciferin to oxyluciferin, RLU output, etc.) in the presence of ATP and a luciferase inhibitor (e.g., dehydroluciferin, fluorodehydroluciferin, aminodehydroluciferin, L-luciferin, etc.) when compared to a reference luciferase (e.g., SEQ ID NO: 1).

"Isolated polynucleotide" as used herein may mean a polynucleotide (e.g., of genomic, cDNA, or synthetic origin, or a combination thereof) that, by virtue of its origin, the isolated polynucleotide is not associated with all or a portion of a polynucleotide with which the "isolated polynucleotide" is found in nature; is operably linked to a polynucleotide that it is not linked to in nature; or does not occur in nature as part of a larger sequence.

"Luciferin" refers to a compound, having the structure:

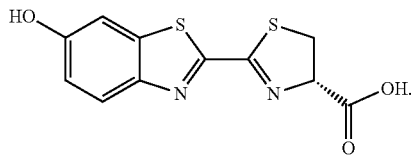 [SMILES: O=C(O)[C@H]1CSC(c2nc3ccc(O)cc3s2)=N1]

Luciferin may be present as "L-luciferin" or "D-luciferin" or a racemic mixture of L- and D-form luciferin. Unless specified otherwise (e.g., "L-luciferin," "a racemic luciferin mixture," etc.), the term "luciferin" refers to the D-form. The term "luciferins" refers more broadly to a class of bioluminescent compounds (or chiral sisters thereof) that serve as substrates for firefly luciferases and include derivatives of luciferin such as aminoluciferin, fluoroluciferin, etc.

"Luciferin derivative" or "Luciferin Analog" to a class of compounds that are structurally related to luciferin, having similar ring structure, and similar, but not necessarily identical, substituents. Luciferin derivatives typically differ from luciferin by the presence or absence of double bonds in the ring structure, and or the presence or different substituents (e.g., halogen group, oxo group, amino group, OH group, $CH_3$ group, CN, etc.). Some luciferin derivatives are substrates of firefly luciferase, others are inhibitors of firefly luciferase. References disclosing luciferin derivatives and luciferin analogs include, for example, Miller, S. C., et al. "Lessons Learned from Luminous Luciferins and Latent Luciferases." ACS Chem Biol. 2018 Feb. 19; and Rathbun, C. M. and J. A. Prescher (2017). "Bioluminescent Probes for Imaging Biology beyond the Culture Dish." Biochemistry 56(39): 5178-5184. Additional analogs are listed in Rathbun, C. M., et al. (2017). "Parallel Screening for Rapid Identification of Orthogonal Bioluminescent Tools." ACS Central Science 3(12): 1254-1261.

"Luciferin reaction product" refers to luciferin derivatives that are not substrates for a firefly luciferase, the production of which from a luciferin is catalyzed by a luciferase (e.g., a firefly luciferase) in a light-producing reaction. Examples of luciferin reaction products include oxyluciferin, aminooxyluciferin, fluorooxyluciferin, etc.

"Luciferin degradation product" refers to luciferin derivatives that are not substrates for a firefly luciferase, the production of which occurs by chemical degradation of a luciferin, in a reaction that is typically not catalyzed by a luciferase and does not result in significant light production. Examples of luciferin reaction products include dehydroluciferin, aminodehydroluciferin, fluorodehydroluciferin, etc.

"Peptide" refers an oligomer to short polymer of amino acids linked together by peptide bonds. In contrast to other amino acid polymers (e.g., proteins, polypeptides, etc.), peptides are of about 50 amino acids or less in length. A peptide may comprise natural amino acids, non-natural amino acids, amino acid analogs, and/or modified amino acids. A peptide may be a subsequence of naturally occurring protein or a non-natural (artificial) sequence.

"Polypeptide" refers to a polymer of amino acids linked together by peptide bonds that is greater than about 50 amino acids in length. Polypeptides may comprise natural amino acids, non-natural amino acids, amino acid analogs and/or modified amino acids, and may be a naturally occurring sequence, or a non-natural (artificial) sequence, or a subsequence of naturally occurring protein or a non-natural (artificial) sequence. "Artificial" refers to compositions and systems that are designed or prepared by man, and are not naturally occurring. For example, an artificial sequence refers to an amino acid or nucleotide sequence that does not occur in nature (e.g., a polypeptide without 100% identity with a naturally-occurring protein or a fragment thereof). "Conservative" amino acid substitution refers to the substitution of an amino acid in a peptide or polypeptide with another amino acid having similar chemical properties, such as size or charge. For purposes of the present disclosure, each of the following eight groups contains amino acids that are conservative substitutions for one another:
1) Alanine (A) and Glycine (G);
2) Aspartic acid (D) and Glutamic acid (E);
3) Asparagine (N) and Glutamine (Q);
4) Arginine (R) and Lysine (K);
5) Isoleucine (I), Leucine (L), Methionine (M), and Valine (V);
6) Phenylalanine (F), Tyrosine (Y), and Tryptophan (W);
7) Serine (S) and Threonine (T); and
8) Cysteine (C) and Methionine (M).

Naturally occurring residues may be divided into classes based on common side chain properties, for example: polar positive (or basic) (histidine (H), lysine (K), and arginine (R)); polar negative (or acidic) (aspartic acid (D), glutamic acid (E)); polar neutral (serine (S), threonine (T), asparagine (N), glutamine (Q)); non-polar aliphatic (alanine (A), valine (V), leucine (L), isoleucine (I), methionine (M)); non-polar aromatic (phenylalanine (F), tyrosine (Y), tryptophan (W)); proline and glycine; and cysteine. As used herein, a "semi-conservative" amino acid substitution refers to the substitution of an amino acid in a peptide or polypeptide with another amino acid within the same class.

In some embodiments, unless otherwise specified, a conservative or semi-conservative amino acid substitution may also encompass non-naturally occurring amino acid residues that have similar chemical properties to the natural residue. These non-natural residues are typically incorporated by chemical peptide synthesis rather than by synthesis in biological systems. These include, but are not limited to, peptidomimetics and other reversed or inverted forms of amino acid moieties. Embodiments herein may, in some embodiments, be limited to natural amino acids, non-natural amino acids, and/or amino acid analogs. Non-conservative substitutions may involve the exchange of a member of one class for a member from another class.

"Sample," "test sample," "specimen," "sample from a subject," and "patient sample" as used herein may be used interchangeable and may be a sample of blood, such as whole blood, tissue, urine, serum, plasma, amniotic fluid, cerebrospinal fluid, placental cells or tissue, endothelial cells, leukocytes, or monocytes. The sample can be used directly as obtained from a patient or can be pre-treated, such as by filtration, distillation, extraction, concentration, centrifugation, inactivation of interfering components, addition of reagents, and the like, to modify the character of the sample in some manner as discussed herein or otherwise as is known in the art.

"Signal duration" refers to the persistence of a signal, for example, as measured by the half-life of decay of the signal in a time-course or the length of time a signal remains constant (e.g., before detectable decay). The term "signal stability" refers to the characteristic signal duration of an enzyme (e.g., a luciferase).

"Sequence identity" refers to the degree two polymer sequences (e.g., peptide, polypeptide, nucleic acid, etc.) have the same sequential composition of monomer subunits. The term "sequence similarity" refers to the degree with which two polymer sequences (e.g., peptide, polypeptide, nucleic acid, etc.) have similar polymer sequences. For example, similar amino acids are those that share the same biophysical characteristics and can be grouped into the families, e.g., acidic (e.g., aspartate, glutamate), basic (e.g., lysine, arginine, histidine), non-polar (e.g., alanine, valine, leucine, isoleucine, proline, phenylalanine, methionine, tryptophan) and uncharged polar (e.g., glycine, asparagine, glutamine, cysteine, serine, threonine, tyrosine). The "percent sequence identity" (or "percent sequence similarity") is calculated by: (1) comparing two optimally aligned sequences over a window of comparison (e.g., the length of the longer sequence, the length of the shorter sequence, a specified window), (2) determining the number of positions containing identical (or similar) monomers (e.g., same amino acids occurs in both sequences, similar amino acid occurs in both sequences) to yield the number of matched positions, (3) dividing the number of matched positions by the total number of positions in the comparison window (e.g., the length of the longer sequence, the length of the shorter sequence, a specified window), and (4) multiplying the result by 100 to yield the percent sequence identity or percent sequence similarity. For example, if peptides A and B are both 20 amino acids in length and have identical amino acids at all but 1 position, then peptide A and peptide B have 95% sequence identity. If the amino acids at the non-identical position shared the same biophysical characteristics (e.g., both were acidic), then peptide A and peptide B would have 100% sequence similarity. As another example, if peptide C is 20 amino acids in length and peptide D is 15 amino acids in length, and 14 out of 15 amino acids in peptide D are identical to those of a portion of peptide C, then peptides C and D have 70% sequence identity, but peptide D has 93.3% sequence identity to an optimal comparison window of peptide C. For the purpose of calculating "percent sequence identity" (or "percent sequence similarity") herein, any gaps in aligned sequences are treated as mismatches at that position. Any polypeptides described herein as having a particular percent sequence identity or similarity (e.g., at least 70%) with a reference sequence ID number, may also be expressed as having a maximum number of substitutions (or terminal deletions) with respect to that reference sequence. For example, a sequence "having at least Y % sequence identity with SEQ ID NO: Z" may have up to X substitutions relative to SEQ ID NO: Z, and may therefore also be expressed as "having X or fewer substitutions relative to SEQ ID NO: Z."

"Storage stability" refers to the consistency of the signal (e.g., luminescence) from an enzyme (e.g., luciferase with luciferin and ATP) when measured at various points in time (e.g., end-point measurements). For example, luminescence of aliquots of a stored luciferase (e.g., stored in an aqueous solution along with substrate) are measured (e.g., in the presence of luciferin and ATP) at various time-points relevant to the storage of the luciferase (e.g., days, weeks, etc.), and an enzyme or set of conditions that result in more consistency (e.g., less loss of signal, longer duration before decay, etc.) over time exhibits "enhanced storage stability." A variant enzyme (e.g., an inhibitor resistant variant) may exhibit enhanced storage stability relative to a wild-type enzyme, and/or a particular set of conditions (e.g., in the presence of inhibitor) may result in enhanced storage stability relative to reference conditions. Some luciferases exhibit limited storage stability when stored in the presence of luciferin, due to the formation of luciferin breakdown products that are inhibitory to the luciferase. In some embodiments, inhibitor-resistant luciferases exhibit increased storage stability. In some embodiments, storage conditions comprising both luciferin substrate and inhibitor (e.g., dehydroluciferin, fluorodehydroluciferin, aminodehydroluciferin, L-luciferin, etc.) result in enhanced storage stability, for example, by decreasing early time-point signal to more closely reflect late time-point signals.

"Subject" and "patient" as used herein interchangeably refers to any vertebrate, including, but not limited to, a mammal and a human. In some embodiments, the subject may be a human or a non-human. The subject or patient may be undergoing forms of treatment. "Mammal" as used herein refers to any member of the class Mammalia, including, without limitation, humans and nonhuman primates such as chimpanzees and other apes and monkey species; farm animals such as cattle, sheep, pigs, goats, llamas, camels, and horses; domestic mammals such as dogs and cats; laboratory animals including rodents such as mice, rats, rabbits, guinea pigs, and the like. The term does not denote a particular age or sex. Thus, adult and newborn subjects, as well as fetuses, whether male or female, are intended to be included within the scope of this term.

"Subsequence" refers to peptide or polypeptide that has 100% sequence identify with another, larger peptide or polypeptide. The subsequence is a perfect sequence match for a portion of the larger amino acid chain.

"Substantially" as used herein means that the recited characteristic, parameter, and/or value need not be achieved exactly, but that deviations or variations, including for example, tolerances, measurement error, measurement accuracy limitations and other factors known to skill in the art, may occur in amounts that do not preclude the effect the characteristic was intended to provide. A characteristic or feature that is substantially absent (e.g., substantially non-luminescent) may be one that is within the noise, beneath background, below the detection capabilities of the assay being used, or a small fraction (e.g., <1%, <0.1%, <0.01%, <0.001%, <0.00001%, <0.000001%, <0.0000001%) of the significant characteristic (e.g., luminescent intensity of a bioluminescent protein or bioluminescent complex).

"Variant" is used herein to describe a peptide or polypeptide that differs in amino acid sequence by the insertion, deletion, or conservative substitution of amino acids, but retain at least one biological activity. "SNP" refers to a variant that is a single nucleotide polymorphism. Representative examples of "biological activity" include the ability to be bound by a specific antibody or to promote an immune response. Variant is also used herein to describe a protein with an amino acid sequence that is substantially identical to a referenced protein with an amino acid sequence that retains at least one biological activity. A conservative substitution of an amino acid (e.g., replacing an amino acid with a different amino acid of similar properties, such as hydrophilicity, degree, and distribution of charged regions) is recognized in the art as typically involving a minor change. These minor changes can be identified, in part, by considering the hydropathic index of amino acids, as understood in the art. The hydropathic index of an amino acid is based on a consideration of its hydrophobicity and charge. It is known in the art that amino acids of similar hydropathic indexes can be substituted and still retain protein function. In one aspect, amino acids having hydropathic indexes of ±2 are substituted. The hydrophilicity of amino acids can also be used to reveal substitutions that would result in proteins retaining biological function. A consideration of the hydrophilicity of amino acids in the context of a peptide permits calculation of the greatest local average hydrophilicity of that peptide, a useful measure that has been reported to correlate well with antigenicity and immunogenicity. Substitution of amino acids having similar hydrophilicity values can result in peptides retaining biological activity, for example immunogenicity, as is understood in the art. Substitutions may be performed with amino acids having hydrophilicity values within +2 of each other. Both the hydrophobicity index and the hydrophilicity value of amino acids are influenced by the particular side chain of that amino acid. Consistent with that observation, amino acid substitutions that are compatible with biological function are understood to depend on the relative similarity of the amino acids, and particularly the side chains of those amino acids, as revealed by the hydrophobicity, hydrophilicity, charge, size, and other properties.

Unless otherwise defined herein, scientific and technical terms used in connection with the present disclosure shall have the meanings that are commonly understood by those of ordinary skill in the art. For example, any nomenclatures used in connection with, and techniques of, cell and tissue culture, molecular biology, immunology, microbiology, genetics and protein and nucleic acid chemistry and hybridization described herein are those that are well known and commonly used in the art. The meaning and scope of the terms should be clear; in the event, however of any latent ambiguity, definitions provided herein take precedent over any dictionary or extrinsic definition. Further, unless otherwise required by context, singular terms shall include pluralities and plural terms shall include the singular.

Thermostable Luciferin Analogs

Embodiments of the present disclosure include improved and enhanced luciferase enzyme variants (e.g., variants of the thermostable luciferase variant of Ppe of SEQ ID NO: 1) that contain mutations conferring high activity (e.g., from 10-fold to 100,000,000-fold improvement) when combined with thermostable 5,5-disubstituted luciferin analogs. The combination of these enhanced luciferase enzymes with thermostable luciferin analogs comprise a bioluminescent assay system/platform for performing bioluminescent assays having improved thermal stability, activity, and longevity. This enhanced bioluminescent assay system/platform provides significant advantages over currently available systems/platforms, for example, by allowing for a simplified, single-liquid reagent formulation that is stable at wide temperature ranges for periods of time that extend beyond current limits with minimal loss in performance. Thermostable luciferin analogs include 5,5-disubstituted luciferins or luciferin analogs shown in FIG. 1. The 5,5-disubstituted luciferins or luciferin analogs exhibit unexpected thermal stability and may provide for a luciferase detection system with substantially-reduced inhibition caused by luciferin decomposition products (e.g., dehydroluciferins).

D-luciferin is the natural substrate for firefly and click beetle luciferases and can be used as a substrate in bioluminescent assays employing luciferase reporter enzymes. However, D-luciferin is thermally unstable and decomposes over time in stock solutions at ambient temperature. Dehydroluciferins have been identified as degradation products of luciferins. These dehydroluciferins are potent inhibitors of luciferases and can lead to decreased light output in luciferase-based bioluminescent assays. In some embodiments, 5,5-disubstituted luciferins are especially useful for applications that require luciferins to be stored in solutions at ambient temperature over long periods of time. In some embodiments, 5,5-disubstituted luciferins provide increased stability and reactivity in many live cell bioluminescent assays or live cell imaging methods. In some embodiments, 5,5-disubstituted luciferins are substrates for a luciferase enzyme that utilize luciferin ("luciferin-utilizing enzymes") to produce luminescence, including, but not limited to, luciferases and photoproteins found in various organisms such as beetles (e.g., Photinus pyralis (Ppy) and *Photuris pennsylvanica* (Ppe) (fireflies of North America), *Pyrophorus plagiophthalamus* (Ppl) (the Jamaican click beetle)), *Renilla reniformis* (the sea pansy), and several bacteria (e.g., *Xenorhabdus luminescens* and *Vibrio* spp). The 5,5-disubstituted luciferins are historically considered incapable of producing light via firefly luciferase mediated processes. Specifically, 5-5-disubstituted luciferins are commonly believed to produce light only via chemiluminescent processes, not via enzymatic processes (e.g., by firefly luciferases). In some embodiments, the disclosed compounds are able to be utilized by click beetle luciferases to produce luminescence via enzymatic processes. In some embodiments, luciferases effectively utilize various stereoisomeric forms and mixtures (e.g., L- and D-forms) of the 5,5-disubstituted luciferin analogues to produce bioluminescence and operate over a broad pH range. In some embodiments, this provides for the use of racemates in applications where racemization can compromise signal stabilities.

Thermostability

In some embodiments, 5,5-disubstituted luciferins exhibit superior thermal stability to other known luciferins. Dehydroluciferin has been identified as a major product resulting from D-luciferin decomposition over time in solution. Dehydroluciferins inhibit luciferases, which leads to decreased light output causing a significant impact on luciferase assays. The disclosed 5,5-disubstituted luciferin analogues exhibit improved thermal stability in solution as very little decomposition occurs with 5,5-dimethyl luciferins (e.g., with 6-OH compound and 6-NH$_2$ compound) while significant decomposition occurs in the unsubstituted luciferin with corresponding production of dehydroluciferin. In some embodiments, the 5,5-disubstitution improves the overall thermal stability of luciferin analogue compounds by eliminating the possibility of dehydroluciferin formation.

As used herein, "thermal stability" or "thermostability" with reference to luciferin/luciferin analogs generally refers to how stable a luciferin analogue compound is in a solution over a certain time period such that it maintains the ability to produce light in the presence of a luciferase, including, for example, live cell assays using a luciferase. The solution of the luciferin analogue may include a liquid media in which a luciferase is present, e.g., an aqueous buffer system for use in a luciferase assay. Stability for the disclosed compounds may be demonstrated by the percentage of degradation of the compounds in a specific environment over time. In some embodiments, the percentage of purity for a particular compound is determined by a variety of techniques known to those of ordinary skill in the art. These techniques include, for example, nuclear magnetic resonance (NMR) and high-performance liquid chromatography (HPLC). In some embodiments, the thermal stability of the disclosed compounds is determined after a solution of a particular compound has been stored, in the absence or presence of a luciferase, at a certain temperature over a certain period of time. The temperature during the storage may be 5° C. or higher, 10° C. or higher, 15° C. or higher, 20° C. or higher, 30° C. or higher, 40° C. or higher, 50° C. or higher, 60° C. or higher, or 70° C. or higher. In some embodiments, the luciferin analog compounds can be combined with a luciferase (or a sample containing a luciferase) in a solution that does not contain any nucleotide triphosphates (e.g., ATP) or species that are able to form nucleotide triphosphates and which can be kept at a temperature (such as 20° C.-70° C.) for a certain period of time.

5,5-disubstituted luciferin analog compounds demonstrate superior thermal stability as compared to luciferin analogues lacking 5,5-disubstitution over the same period of time. In some embodiments, the present compounds show an improved thermal stability of at least 10%, at least 20%, at least 30%, at least 40%, at least 50%, at least 60%, at least 70%, at least 80%, at least 90%, at least 100%, at least 150%, at least 200%, at least 250%, at least 300%, at least 350%, at least 400%, at least 450%, or at least 500% as compared to luciferins or luciferin analogues lacking 5,5-disubstitution. The remarkable stability of these luciferin analog compounds allows for longer storage without decomposition of the luciferin analogues, which may be used for a variety of enhancements of luminogenic assays.

In some embodiments, the thermal stability of the present compounds is enhanced by storing them in solution with additives. These additives may enhance the stability of the luciferin analog compounds by preventing oxidative decomposition or other forms of decomposition. The stability enhancement may be through scavenging of reactive oxygen species such as oxygen or hydrogen peroxide, by converting oxidized compounds back to the original compound through reduction, or by another mechanism. In some embodiments, these additives are compatible with the reaction of the present luciferin analog compounds with a luciferase, causing no decrease in light production. In some embodiments, these additives are Azathiothymidine (ATT) or analogs thereof, as described in U.S. Ser. No. 62/541,350, which is incorporated by reference herein in its entirety. In some embodiments, the additive is thiourea or another carbon-sulfur double bond containing compound.

As used herein, "thermal stability" or "thermostability" with reference to enzyme variants described herein generally refers to the consistency of a signal (e.g., luminescence) from an enzyme variant (e.g., a luciferase variant with luciferin and ATP) when measured at various temperatures and at various points in time. For example, luminescence of aliquots of a luciferase variant (e.g., stored in an aqueous solution along with substrate) are measured (e.g., in the presence of luciferin and ATP) at various time-points (e.g., minutes, hours, days, weeks, etc.) and at various temperatures, and an enzyme or set of conditions that results in more consistency (e.g., less loss of signal, longer duration before decay, etc.) over time and at a given temperature may exhibit "thermostability." In some cases, thermostability of an enzyme variant is measured against, or compared to, the thermostability of a reference luciferase enzyme or a reference luciferase variant enzyme, and thermostability may be improved or enhanced based on the reference enzyme (e.g., less loss of signal, longer duration before decay, etc.) over time and at a given temperature.

Light Production

The 5,5-disubstituted luciferin analog compounds produce sufficient light when used in conjunction with the luciferase enzyme variants described herein to be suitable substrates for use in luciferase assays. In some embodiments, the luciferase enzyme variants disclosed herein provide a much stronger light signal with 5,5-dimethyl luciferins than is seen with other luciferases in luciferase assays under various conditions. Prior to the present disclosure, it was unclear from previous studies whether any particular 5,5-disubstituted luciferin analogues would produce sufficient light to be useful in luciferase assays.

In some embodiments, the luciferin analog compounds provide a stable luminescent signal in a solution at ambient or elevated temperature (such as 30-70° C.) for a period of at least 24 hours, at least 48 hours, at least 60 hours, at least 80 hours, at least 100 hours, at least 120 hours, at least 150 hours, at least 200 hours, at least 250 hours, at least 300 hours, at least 350 hours, or at least 400 hours. In some embodiments, the luciferin analog compounds provide a stable luminescence signal in a luciferase assay medium at ambient temperature for a period of 100-400 hours. The disclosed luciferin analog compounds having improved thermal stabilities in solution allow for applications that require long term storage of luciferins in solutions over time at ambient temperature. The luciferin analog compounds may be particularly useful for applications where formation of dehydroluciferin is significant and detrimental such as Reactive Oxygen Species (ROS) detection or cytochrome P450 (CYP450) assays.

Enhanced Luciferase Enzymes

Embodiments of the present disclosure provide improved and enhanced luciferase enzyme variants (e.g., variants of the thermostable luciferase variant of Ppe of SEQ ID NO: 1) that contain amino acid substitutions that confer high activity (e.g., from 10-fold to 1,000,000-fold improvement, or higher) when combined with thermostable 5,5-disubstituted luciferin analogs in bioluminescent assays. As shown in FIGS. 2A-2B, luciferase enzyme variant polypeptides were generated based on the sequence of the a thermostable luciferase variant of Ppe (ATG-2287 or SEQ ID NO: 1) as part of an effort to identify variants having improved activity (e.g., bioluminescent signal) in the presence of thermostable 5,5-disubstituted luciferin analogs as compared to a bioluminescent signal produced by the luciferase polypeptide of SEQ ID NO: 1. FIGS. 2A and 2B summarize the generation of these luciferase enzyme variant polypeptides using an active site saturation screen, rational mutagenesis, a dehydro-LH$_2$ resistance screen, combinatorial analysis, linear regression analysis, and error-prone PCR and DNA shuffling. Amino acid substitutions relative to SEQ ID NO: 1 identified in the luciferase polypeptides of the present disclosure are provided below in Table 1.

TABLE 1

Enhanced luciferase polypeptides

| SEQ ID NO: | ID: | Amino Acid Substitutions |
|---|---|---|
| 1 | ATG-2287 | — |
| 2 | ATG-3707 | H244W + T344A + I396K + S193A + N228D + L305F + S306P + I109V |
| 3 | ATG-2624 | I240L + Y254S + T344A + I396K |
| 4 | ATG-2625 | N74N + H244R + V300G + I396K |
| 5 | ATG-2877 | H244W |
| 6 | ATG-2879 | H244W + Y254S + T344A + I396K |
| 7 | ATG-2884 | H244W + Y254S |
| 8 | ATG-2885 | H244W + T344A |
| 9 | ATG-2886 | H244W + I396K |
| 10 | ATG-2887 | H244W + Y254S + T344A |
| 11 | ATG-2888 | H244W + Y254S + I396K |
| 12 | ATG-2889 | H244W + T344A + I396K |
| 13 | ATG-2890 | I240L + H244W + Y254S + T344A + I396K |
| 14 | ATG-3549 | H244W + T344A + I396K + V300G |
| 15 | ATG-3550 | H244W + T344A + I396K + V300G + L305F |
| 16 | ATG-3551 | H244W + T344A + I396K + V300G + S306P |
| 17 | ATG-3552 | H244W + T344A + I396K + V300G + L305P + S306P |
| 18 | ATG-3553 | H244W + T344A + I396K + L305P + S306P |
| 19 | C4582F2 (P1B4) | H244W + T344A + I396K + S193A + N228D + L305F |
| 20 | C4583A3 (P1B6) | H244W + T344A + I396K + N228D + V287I |
| 21 | C4584D7 (P1B10) | H244W + T344A + I396K + N228D + V300G + L305F |
| 22 | C4599F7 (P1D12) | H244W + T344A + I396K + I214L + V262A + L305F + V335G |
| 23 | C4615B7 (P1F11) | H244W + T344A + I396K + N228D + L305F |
| 24 | ATG-3673 | H244W + T344A + I396K + I109V + S193A + F218L + N228D + S234T + V262A + L294H + L305F + S306P + K309E + A316S + V335G + V533M |
| 25 | ATG-3674 | H244W + T344A + I396K + S193A + N228D + L305F + S306P |
| 26 | ATG-3675 | H244W + T344A + I396K + I109V + V262A + L305F + S306P + V335G + V533M |
| 27 | ATG-3708 | H244W + T344A + I396K + S193A + N228D + L305F + S306P + Q133H |
| 28 | ATG-3709 | H244W + T344A + I396K + S193A + N228D + L305F + S306P + I214L |
| 29 | ATG-3710 | H244W + T344A + I396K + S193A + N228D + L305F + S306P + F218L |
| 30 | ATG-3711 | H244W + T344A + I396K + S193A + N228D + L305F + S306P + T233S |
| 31 | ATG-3712 | H244W + T344A + I396K + S193A + N228D + L305F + S306P + S234T |
| 32 | ATG-3713 | H244W + T344A + I396K + S193A + N228D + L305F + S306P + I236V |
| 33 | ATG-3714 | H244W + T344A + I396K + S193A + N228D + L305F + S306P + V262A |
| 34 | ATG-3715 | H244W + T344A + I396K + S193A + N228D + L305F + S306P + V335G |
| 35 | ATG-3716 | H244W + T344A + I396K + S193A + N228D + L305F + S306P + S503R |
| 36 | ATG-3717 | H244W + T344A + I396K + S193A + N228D + L305F + S306P + I214L + F218L |
| 37 | ATG-3718 | H244W + T344A + I396K + S193A + N228D + L305F + S306P + T233S + S234T |
| 38 | ATG-3719 | H244W + T344A + I396K + S193A + N228D + L305F + S306P + S234T + I236V |
| 39 | ATG-3720 | H244W + T344A + I396K + S193A + N228D + L305F + S306P + T233S + I236V |
| 40 | C2240E2 | H244W + T344A + I396K + S193A + N228D + L305F + S306P + I109V + I230F + V335G + I410M |
| 41 | C2261D9 | H244W + T344A + I396K + S193A + N228D + L305F + S306P + I109V + C38R + Y108F + T376I |
| 42 | C2242E1 | H244W + T344A + I396K + S193A + N228D + L305F + S306P + I109V + C38R + F55I + V262A + I422V |
| 43 | C2260B6 | H244W + T344A + I396K + S193A + N228D + L305F + S306P + I109V + Y108F + V261A + N427D + F431V |
| 44 | C2158H1 | H244W + T344A + I396K + S193A + N228D + L305F + S306P + I109V + I230F |
| 45 | C2158A3 | H244W + T344A + I396K + S193A + N228D + L305F + S306P + I109V + Q487R |
| 46 | C2158H3 | H244W + T344A + I396K + S193A + N228D + L305F + S306P + I109V + N154S + V261A + I410M |
| 47 | C2262C2 | H244W + T344A + I396K + S193A + N228D + L305F + S306P + I109V + Y183C + V261A + T289S |
| 48 | C2159F8 | H244W + T344A + I396K + S193A + N228D + L305F + S306P + I109V + Y32C |
| 49 | C2149A12 | H244W + T344A + I396K + S193A + N228D + L305F + S306P + I109V + F246Y + V261A |
| 50 | C2261E4 | H244W + T344A + I396K + S193A + N228D + L305F + S306P + I109V + I230F |
| 51 | C2160C1 | H244W + T344A + I396K + S193A + N228D + L305F + S306P + I109V + K121Q + F246Y + V261A |
| 52 | C2261D1 | H244W + T344A + I396K + S193A + N228D + L305F + S306P + I109V + K121Q + V261A + V287I |
| 53 | C4580B10 | H244W + T344A + I396K + K107Q + S193T + V262A |
| 54 | C4580E9 | H244W + T344A + I396K + N228D + V287I |
| 55 | C4581C3 | H244W + T344A + I396K + I109M + S193L |
| 56 | C4584D9 | H244W + T344A + I396K + I109M + S193L + L294H |
| 57 | C4584G5 | H244W + T344A + I396K + K107Q + L305F |

TABLE 1-continued

Enhanced luciferase polypeptides

| SEQ ID NO: | ID: | Amino Acid Substitutions |
|---|---|---|
| 58 | C4588H8 | H244W + T344A + I396K + K107Q + L305F |
| 59 | C4589D5 | H244W + T344A + I396K + A40A + K107Q + S193T + A316S |
| 60 | C4598F8 | H244W + T344A + I396K + I109V + V262A + V287I + K309N |
| 61 | C4601C8 | H244W + T344A + I396K + S193P |
| 62 | C4604A11 | H244W + T344A + I396K + I109M + A316S |
| 63 | C4608E7 | H244W + T344A + I396K + K121N + N228D + V287I |
| 64 | C4609F7 | H244W + T344A + I396K + Y108F + V262A + L305F |
| 65 | C4610C10 | H244W + T344A + I396K + S306P |
| 66 | C4610H6 | H244W + T344A + I396K + K107Q + N228D |
| 67 | C4629G5 | H244W + T344A + I396K + I236V |
| 68 | C7612E10 | H244W + T344A + I396K + S193A + N228D + L305F + S306P + I109V + V348I |
| 69 | C7573G10 | H244W + T344A + I396K + S193A + N228D + L305F + S306P + I109V + A316M |
| 70 | C7573H3/ ATG4117 | H244W + T344A + I396K + S193A + N228D + L305F + S306P + I109V + A316W |
| 71 | C7579E3 | H244W + T344A + I396K + S193A + N228D + L305F + S306P + I109V + Y339M |
| 72 | C7582A5 | H244W + T344A + I396K + S193A + N228D + L305F + S306P + I109V + T342S |
| 73 | C7584F2 | H244W + T344A + I396K + S193A + N228D + L305F + S306P + I109V + A344I |
| 74 | C2157D2 | H244W + T344A + I396K + S193A + N228D + L305F + S306P + I109V + K107N + T289S |
| 75 | MK0108 | I109V |
| 76 | MK0109 | S193A |
| 77 | MK0110 | H244W |
| 78 | MK0111 | L305F |
| 79 | MK0112 | S306P |
| 80 | MK0113 | T344A |
| 81 | MK0114 | T344M |
| 82 | MK0115 | I396K |
| 83 | MK0116 | I396L |
| 84 | MK0117 | H244W + T344A + I396K + S193A + N228D + L305F + S306P |
| 85 | MK0118 | H244W + T344A + I396K + N228D + L305F + S306P + I109V |
| 86 | MK0119 | T344A + I396K + S193A + N228D + L305F + S306P + I109V |
| 87 | MK0120 | H244W + T344A + I396K + S193A + N228D + S306P + I109V |
| 88 | MK0121 | H244W + T344A + I396K + S193A + N228D + L305F + I109V |
| 89 | MK0122 | H244W + I396K + S193A + N228D + L305F + S306P + I109V |
| 90 | MK0123 | H244W + T344A + S193A + N228D + L305F + S306P + I109V |
| 91 | MK0124 | H244W + T344M + I396K + S193A + N228D + L305F + S306P + I109V |
| 92 | MK0125 | H244W + T344A + I396L + S193A + N228D + L305F + S306P + I109V |
| 93 | MK0127 | H244W + T344A + I396K + S193A + L305F + S306P + I109V |
| 94 | C8523E12 | H244W + T344A + I396K + S193A + N228D + L305F + S306P + I109V + C38R + F55I + A316W + T342S + V348I |
| 95 | C9715F9 | H244W + T344A + I396K + S193A + N228D + L305F + S306P + I109V + C38R + A316W + T342S + V348I + K205N |
| 96 | C9673G4 | H244W + T344A + I396K + S193A + N228D + L305F + S306P + I109V + C38R + F55I + A316W + T342S + V348I + I396I |
| 97 | C9644H7 | H244W + T344A + I396K + S193A + N228D + L305F + S306P + I109V + C38R + A316W + T342S + V348I |
| 98 | C9649G7 | H244W + T344A + I396K + S193A + N228D + L305F + S306P + I109V + C38R + F55I + K121Q + A316W + Y339M + T344I + V348I |
| 99 | C9679H10 | H244W + T344A + I396K + S193A + N228D + L305F + S306P + I109V + A316W + T344I |
| 100 | C9671D10 | H244W + T344A + I396K + S193A + N228D + L305F + S306P + I109V + C38R + F55I + Y108F + A316W + Y339M + T344I |
| 101 | MK0133 | H244W + T344I + I396K + S193A + N228D + L305F + S306P + I109V + C38R + F55I + A316W + T342S + V348I |
| 102 | MK0134 | H244W + T344A + I396K + S193A + N228D + L305F + S306P + I109V + C38R + F55I + Y108F + A316W + Y339M |
| 103 | MK0135 | H244W + S193A + N228D + L305F + S306P + I109V + C38R + F55I + A316W + T342S + V348I |
| 104 | MK0136 | H244W + S193A + N228D + L305F + S306P + I109V + C38R + F55I + Y108F + A316W + Y339M |
| 105 | MK0137 | H244W + S193A + N228D + L305F + S306P + I109V + C38R + F55I + Y108F + A316W + Y339M + T342S + V348I |
| 106 | MK0138 | H244W + S193A + N228D + L305F + S306P + I109V + C38R + F55I + Y108F + A316W + Y339M + T344I + I396K |
| 107 | MK0139 | H244W + S193A + N228D + L305F + S306P + I109V + C38R + F55I + Y108F + A316W + Y339M + T342S + V348I + I240V |
| 108 | MK0141 | H244W + S193A + N228D + L305F + S306P + I109V + C38R + F55I + Y108F + A316W + Y339M + T342S + V348I + T284A |
| 109 | MK0142 | H244W + S193A + N228D + L305F + S306P + I109V + C38R + F55I + Y108F + A316W + Y339M + T342S + V348I + T289R |
| 110 | MK0144 | H244W + S193A + N228D + L305F + S306P + I109V + C38R + F55I + Y108F + A316W + Y339M + T342S + V348I + K353R |
| 111 | MK0145 | H244W + S193A + N228D + L305F + S306P + I109V + C38R + F55I + Y108F + A316W + Y339M + T342S + V348I + D435G |

TABLE 1-continued

Enhanced luciferase polypeptides

| SEQ ID NO: | ID: | Amino Acid Substitutions |
|---|---|---|
| 112 | MK0146 | H244W + S193A + N228D + L305F + S306P + I109V + C38R + F55I + Y108F + A316W + Y339M + T342S + V348I + L437R |
| 113 | MK0147 | H244W + S193A + N228D + L305F + S306P + I109V + C38R + F55I + Y108F + A316W + Y339M + T342S + V348I + W510R |
| 114 | MK0148 | H244W + S193A + N228D + L305F + S306P + I109V + C38R + F55I + Y108F + A316W + Y339M + T342S + V348I + C257R + T289S + S313T + D435G + L437R + W510R |
| 115 | MK0149 | H244W + S193A + N228D + L305F + S306P + I109V + C38R + F55I + Y108F + A316W + Y339M + T342S + V348I + C257R + T284A + T289S + L437R |
| 116 | MK0151 | H244W + S193A + N228D + L305F + S306P + I109V + C38R + F55I + Y108F + A316W + Y339M + T342S + V348I + S313T + D435G + L437R |
| 117 | MK0152 | H244W + S193A + N228D + L305F + S306P + I109V + C38R + F55I + Y108F + A316W + Y339M + T342S + V348I + C257R + K353R + L437R + W510R |
| 118 | MK0153 | H244W + S193A + N228D + L305F + S306P + I109V + C38R + F55I + Y108F + A316W + Y339M + T342S + V348I + T289S + K353R + D435G + W510R |
| 119 | MK0154 | H244W + S193A + N228D + L305F + S306P + I109V + C38R + F55I + Y108F + A316W + Y339M + T342S + V348I + C257R + T284A + T289S + S313T + K353R + D435G + L437R + W510R |
| 120 | MK0155 | H244W + S193A + N228D + L305F + S306P + I109V + C38R + F55I + Y108F + A316W + Y339M + T342S + V348I + T284A + S313T + K353R + L437R + W510R |
| 121 | MK0156 | H244W + S193A + N228D + L305F + S306P + I109V + C38R + F55I + Y108F + A316W + Y339M + T342S + V348I + C257R + T289S + S313T + K353R |
| 122 | MK0157 | H244W + S193A + N228D + L305F + S306P + I109V + C38R + F55I + Y108F + A316W + Y339M + T342S + V348I + T284A + T289S + K353R + D435G + L437R |
| 123 | MK0158 | H244W + S193A + N228D + L305F + S306P + I109V + C38R + F55I + Y108F + A316W + Y339M + T342S + V348I + C257R + T284A + S313T + K353R + D435G |
| 124 | MK0159 | H244W + S193A + N228D + L305F + S306P + I109V + C38R + F55I + Y108F + A316W + Y339M + T342S + V348I + T284A + T289S + S313T + W510R |

In some embodiments, a luciferase enzyme variant of the present disclosure includes a luciferase polypeptide capable of producing an increased bioluminescent signal in the presence of a 5,5-disubstituted luciferin analog compared to a bioluminescent signal produced by a thermostable luciferase variant of Ppe (SEQ ID NO: 1) in the presence of the 5,5-disubstituted luciferin analog. In accordance with these embodiments, the luciferase enzyme variant polypeptide is not naturally occurring. In some embodiments, the bioluminescent signal produced by the luciferase enzyme variant polypeptide of SEQ ID NO: 1 in the presence of the 5,5-disubstituted luciferin analog is approximately at background levels (e.g., the amount of bioluminescent signal produced in the absence of a luminogenic substrate) or less than background levels (inhibited by the luciferin analog).

In some embodiments, a luciferase enzyme variant of the present disclosure includes a luciferase polypeptide comprising at least 70% sequence identity with the polypeptide of SEQ ID NO: 2 (e.g., 70%, 75%, 80%, 85%, 90%, 95%, 96%, 97%, 98%, 99%, 100%, or ranges therebetween). In some embodiments, a luciferase enzyme variant of the present disclosure includes a luciferase polypeptide comprising less than 100% sequence identity with the polypeptide of SEQ ID NO: 1 (e.g., 99%, 98%, 97%, 96%, 95%, 90%, 85%, 80%, 75%, 70%, or ranges therebetween). In some embodiments, a luciferase enzyme variant of the present disclosure comprises at least 70% (e.g., 70%, 75%, 80%, 85%, 90%, 95%, 96%, 97%, 98%, 99%, 100%, or ranges therebetween) sequence similarity (e.g., conservative or semi-conservative) with SEQ ID NO: 1. In some embodiments, a luciferase enzyme variant comprises 100 or fewer (e.g., 0, 1, 2, 3, 4, 5, 6, 7, 8, 9, 10, 15, 20, 25, 30, 35, 40, 45, 50, 60, 70, 80, 90, 100, or ranges therebetween) amino acid substitutions relative to SEQ ID NO: 1. In some embodiments, a luciferase enzyme variant comprises 100 or fewer (e.g., 0, 1, 2, 3, 4, 5, 6, 7, 8, 9, 10, 15, 20, 25, 30, 35, 40, 45, 50, 60, 70, 80, 90, 100, or ranges therebetween) non-conservative substitutions relative to SEQ ID NO: 1. In some embodiments, a luciferase enzyme variant comprises 100 or fewer (e.g., 0, 1, 2, 3, 4, 5, 6, 7, 8, 9, 10, 15, 20, 25, 30, 35, 40, 45, 50, 60, 70, 80, 90, 100, or ranges therebetween) semi-conservative substitutions relative to SEQ ID NO: 1. In some embodiments, a luciferase enzyme variant comprises 100 or fewer (e.g., 0, 1, 2, 3, 4, 5, 6, 7, 8, 9, 10, 15, 20, 25, 30, 35, 40, 45, 50, 60, 70, 80, 90, 100, or ranges therebetween) conservative substitutions relative to SEQ ID NO: 1.

In some embodiments, a luciferase enzyme variant of the present disclosure includes at least one amino acid substitution at positions 244, 249, 337, and 339 relative to SEQ ID NO: 1. In some embodiments, the luciferase enzyme variant includes amino acid substitutions at positions 244, 249, 337, and 339 relative to SEQ ID NO: 1. In some embodiments, a luciferase enzyme variant includes a H244W substitution relative to SEQ ID NO: 1. In some embodiments, a luciferase enzyme variant includes a H244G substitution relative to SEQ ID NO: 1. In some embodiments, a luciferase enzyme variant includes a H244R substitution relative to SEQ ID NO: 1.

In some embodiments, a luciferase enzyme variant of the present disclosure includes at least one amino acid substitution at positions 240, 254, and 344 relative to SEQ ID NO: 1. In some embodiments, the luciferase enzyme variant includes amino acid substitutions at positions 240, 254, and 344 relative to SEQ ID NO: 1. In some embodiments, a luciferase enzyme variant includes a I240L substitution relative to SEQ ID NO: 1. In some embodiments, a luciferase enzyme variant includes a Y254S substitution relative to SEQ ID NO: 1. In some embodiments, a luciferase enzyme variant includes a T344A substitution relative to SEQ ID NO: 1.

In some embodiments, a luciferase enzyme variant of the present disclosure includes at least one amino acid substitution at positions 300 and 396 relative to SEQ ID NO: 1. In some embodiments, the luciferase enzyme variant includes amino acid substitutions at positions 300 and 396 relative to SEQ ID NO: 1. In some embodiments, a luciferase enzyme variant includes a V300G substitution relative to SEQ ID NO: 1. In some embodiments, a luciferase enzyme variant includes a I396K substitution relative to SEQ ID NO: 1.

In some embodiments, a luciferase enzyme variant of the present disclosure includes at least one amino acid substitution at positions 245, 285, and 315 relative to SEQ ID NO: 1. In some embodiments, the luciferase enzyme variant includes amino acid substitutions at positions 245, 285, and 315 relative to SEQ ID NO: 1. In some embodiments, a luciferase enzyme variant includes a G245A substitution relative to SEQ ID NO: 1. In some embodiments, a luciferase enzyme variant includes a L285I substitution relative to SEQ ID NO: 1. In some embodiments, a luciferase enzyme variant includes a G315A substitution relative to SEQ ID NO: 1.

In some embodiments, a luciferase enzyme variant of the present disclosure includes at least one amino acid substitution at positions 109, 193, 214, 218, 228, 234, 262, 287, 294, 305, 306, 309, 316, 335, and 533 relative to SEQ ID NO: 1. In some embodiments, the luciferase enzyme variant includes amino acid substitutions at positions 109, 193, 214, 218, 228, 234, 262, 287, 294, 305, 306, 309, 316, 335, and 533 relative to SEQ ID NO: 1. In some embodiments, a luciferase enzyme variant includes a I109V substitution relative to SEQ ID NO: 1. In some embodiments, a luciferase enzyme variant includes a S193A substitution relative to SEQ ID NO: 1. In some embodiments, a luciferase enzyme variant includes a I214L substitution relative to SEQ ID NO: 1. In some embodiments, a luciferase enzyme variant includes a F218L substitution relative to SEQ ID NO: 1. In some embodiments, a luciferase enzyme variant includes a N228D substitution relative to SEQ ID NO: 1. In some embodiments, a luciferase enzyme variant includes a S234T substitution relative to SEQ ID NO: 1. In some embodiments, a luciferase enzyme variant includes a V262A substitution relative to SEQ ID NO: 1. In some embodiments, a luciferase enzyme variant includes a V287I substitution relative to SEQ ID NO: 1. In some embodiments, a luciferase enzyme variant includes a L294H substitution relative to SEQ ID NO: 1. In some embodiments, a luciferase enzyme variant includes a L305F substitution relative to SEQ ID NO: 1. In some embodiments, a luciferase enzyme variant includes a S306P substitution relative to SEQ ID NO: 1. In some embodiments, a luciferase enzyme variant includes a K309E substitution relative to SEQ ID NO: 1. In some embodiments, a luciferase enzyme variant includes a A316S substitution relative to SEQ ID NO: 1. In some embodiments, a luciferase enzyme variant includes a V335G substitution relative to SEQ ID NO: 1. In some embodiments, a luciferase enzyme variant includes a V553M substitution relative to SEQ ID NO: 1.

In some embodiments, a luciferase enzyme variant of the present disclosure includes at least one amino acid substitution at positions 133, 233, 236, and 503 relative to SEQ ID NO: 1. In some embodiments, the luciferase enzyme variant includes amino acid substitutions at positions 133, 233, 236, and 503 relative to SEQ ID NO: 1. In some embodiments, a luciferase enzyme variant includes a Q133H substitution relative to SEQ ID NO: 1. In some embodiments, a luciferase enzyme variant includes a T233S substitution relative to SEQ ID NO: 1. In some embodiments, a luciferase enzyme variant includes a I236V substitution relative to SEQ ID NO: 1. In some embodiments, a luciferase enzyme variant includes a S503R substitution relative to SEQ ID NO: 1.

In some embodiments, a luciferase enzyme variant of the present disclosure includes any combinations of the aforementioned amino acid substitutions, including any of the combinations of amino acid substitutions corresponding to the luciferase enzyme variants listed in Table 1.

In some embodiments, a luciferase enzyme variant includes amino acid substitutions I240L, Y254S, T344A, and I396K relative to SEQ ID NO: 1 and/or any conservative or semi-conservative variations of the amino acid substitutions (e.g., ATG-2624). In some embodiments, a luciferase enzyme variant includes amino acid substitutions N74N, H244R, V300G, and I396K relative to SEQ ID NO: 1 and/or any conservative or semi-conservative variations of the amino acid substitutions (e.g., ATG-2625). In some embodiments, a luciferase enzyme variant includes amino acid substitution H244W relative to SEQ ID NO: 1 and/or any conservative or semi-conservative variations of the amino acid substitution (e.g., ATG-2877). In some embodiments, a luciferase enzyme variant includes amino acid substitutions H244W, Y254S, T344A, and I396K relative to SEQ ID NO: 1 and/or any conservative or semi-conservative variations of the amino acid substitutions (e.g., ATG-2879). In some embodiments, a luciferase enzyme variant includes amino acid substitutions H244W, T344A, and I396K relative to SEQ ID NO: 1 and/or any conservative or semi-conservative variations of the amino acid substitutions (e.g., ATG-2889). In some embodiments, a luciferase enzyme variant includes amino acid substitutions H244W, T344A, I396K, V300G, L305P, and S306P relative to SEQ ID NO: 1 and/or any conservative or semi-conservative variations of the amino acid substitutions (e.g., ATG-3552). In some embodiments, a luciferase enzyme variant includes amino acid substitutions H244W, Y254S, T344A, S193A, N228D, L305F, S306P, and I109V relative to SEQ ID NO: 1 and/or any conservative or semi-conservative variations of the amino acid substitutions (e.g., ATG-3707).

In some embodiments, provided herein are luciferase enzyme variants that are thermally stable (e.g., stable at storage temperatures above 0° C. (e.g., 1° C., 2° C., 3° C., 4° C., 5° C., 6° C., 7° C., 8° C., 9° C., 10° C., 11° C., 12° C., 13° C., 14° C., 15° C., 16° C., 17° C., 18° C., 19° C., 20° C., 21° C., 22° C., 23° C., 24° C., 25° C., 26° C., 27° C., 28° C., 29° C., 30° C., 31° C., 32° C., 33° C., 34° C., 35° C., 36° C., 37° C., 38° C., 39° C., 40° C., or ranges therebetween)). In some embodiments, a luciferase enzyme variant exhibits less than 20% (e.g., 19%, 18%, 17%, 16%, 15%, 14%, 13%, 12%, 11%, 10%, 9%, 8%, 7%, 6%, 5%, 4%, 3%, 2%, 1%, or less, or ranges therebetween (e.g., 5% or less)) loss of activity when stored at temperatures above 0° C. (e.g., 1° C., 2° C., 3° C., 4° C., 5° C., 6° C., 7° C., 8° C., 9° C., 10° C., 11° C., 12° C., 13° C., 14° C., 15° C., 16° C., 17° C., 18° C., 19° C., 20° C., 21° C., 22° C., 23° C., 24° C., 25° C., 26° C., 27° C., 28° C., 29° C., 30° C., 31° C., 32° C., 33° C., 34° C., 35° C., 36° C., 37° C., 38° C., 39° C., 40° C., or ranges therebetween) for 1 to 365 days (e.g., 1 day, 2 days, 5 days, 10 days, 20 days, 30 days, 40 days, 50 days, 75 days, 100 days, 150 days, 200 days, 250 days, 300 days, 350 days, 365 days, or ranges therebetween). In some embodiments, a luciferase enzyme variant exhibits enhanced thermal stability relative to a luciferase of SEQ ID NO: 1.

In some embodiments, provided herein are luciferase enzyme variants that are thermally stable (e.g., stable at incubation temperatures above room temperature (e.g., 25° C., 26° C., 27° C., 28° C., 29° C., 30° C., 31° C., 32° C., 33° C., 34° C., 35° C., 36° C., 37° C., 38° C., 39° C., 40° C., 41° C., 42° C., 43° C., 44° C., 45° C., 46° C., 47° C., 48° C., 49° C., 50° C. or ranges therebetween)). In some embodiments, a luciferase enzyme variant described herein exhibits less than 20% (e.g., 19%, 18%, 17%, 16%, 15%, 14%, 13%, 12%, 11%, 10%, 9%, 8%, 7%, 6%, 5%, 4%, 3%, 2%, 1%, or less, or ranges therebetween (e.g., 5% or less)) loss of activity following incubation temperatures above room temperature (e.g., 25° C., 26° C., 27° C., 28° C., 29° C., 30° C., 31° C., 32° C., 33° C., 34° C., 35° C., 36° C., 37° C., 38° C., 39° C., 40° C., 41° C., 42° C., 43° C., 44° C., 45° C., 46° C., 47° C., 48° C., 49° C., 50° C. or ranges therebetween) for 1 to 100 minutes (e.g., 1 minute, 2 minutes, 5 minutes, 10 minutes 15 minutes, 20 minutes, 25 minutes, 30 minutes, 35 minutes, 40 minutes, 45 minutes, 50 minutes, 55 minutes, 60 minutes, 65 minutes, 70 minutes, 75 minutes, 80 minutes, 85 minutes, 90 minutes, 95 minutes, 100 minutes, or ranges therebetween). In some embodiments, a luciferase enzyme variant described herein exhibits enhanced thermal stability relative to a luciferase of SEQ ID NO: 1.

In some embodiments, luciferase enzyme variants described herein are stable when stored in the presence of luciferin (e.g., D-luciferin, racemic luciferin mix) and/or luciferin derivatives (e.g., 5,5-disubstituted luciferin analogs). In some embodiments, a luciferase enzyme variant herein exhibits less than 20% (e.g., 19%, 18%, 17%, 16%, 15%, 14%, 13%, 12%, 11%, 10%, 9%, 8%, 7%, 6%, 5%, 4%, 3%, 2%, 1%, or less, or ranges therebetween (e.g., 5% or less)) loss of activity when stored in the presence of luciferin and/or luciferin derivatives (e.g., 5,5-disubstituted luciferin analogs) for 1 to 365 days (e.g., 1 day, 2 days, 5 days, 10 days, 20 days, 30 days, 40 days, 50 days, 75 days, 100 days, 150 days, 200 days, 250 days, 300 days, 350 days, 365 days, or ranges therebetween). In some embodiments, a luciferase enzyme variant described herein exhibits enhanced stability in the presence of luciferin and/or luciferin derivatives (e.g., 5,5-disubstituted luciferin analogs) relative to a luciferase of SEQ ID NO: 1.

In some embodiments, luciferase enzyme variants described herein are stable in the presence of luciferin break-down products (e.g., dehydroluciferin) and/or the breakdown products of luciferin derivatives (e.g., fluorodehydroluciferin, aminodehydroluciferin, breakdown products of 5,5-disubstituted luciferin analogs, etc.). In some embodiments, a luciferase enzyme variant described herein exhibits less than 20% (e.g., 19%, 18%, 17%, 16%, 15%, 14%, 13%, 12%, 11%, 10%, 9%, 8%, 7%, 6%, 5%, 4%, 3%, 2%, 1%, or less, or ranges therebetween (e.g., 5% or less)) loss of activity when stored in the presence of luciferin break-down products (e.g., dehydroluciferin) and/or the breakdown products of luciferin derivatives (e.g., fluorodehydroluciferin, aminodehydroluciferin, breakdown products of 5,5-disubstituted luciferin analogs, etc.) for 1 to 365 days (e.g., 1 day, 2 days, 5 days, 10 days, 20 days, 30 days, 40 days, 50 days, 75 days, 100 days, 150 days, 200 days, 250 days, 300 days, 350 days, 365 days, or ranges therebetween). In some embodiments, a luciferase enzyme variant described herein exhibits enhanced resistance to inhibition by luciferin break-down products (e.g., dehydroluciferin) and/or the break-down products of luciferin derivatives (e.g., fluorodehydroluciferin, aminodehydroluciferin, breakdown products of 5,5-disubstituted luciferin analogs, etc.) relative to a luciferase of SEQ ID NO: 1.

In some embodiments, luciferase enzyme variants described herein are stable in the presence of L-luciferin and/or a racemic luciferin mix. In some embodiments, a luciferase enzyme variant described herein exhibits less than 20% (e.g., 19%, 18%, 17%, 16%, 15%, 14%, 13%, 12%, 11%, 10%, 9%, 8%, 7%, 6%, 5%, 4%, 3%, 2%, 1%, or less, or ranges therebetween (e.g., 5% or less)) of activity when stored in the presence of L-luciferin and/or a racemic luciferin mix for 1 to 365 days (e.g., 1 day, 2 days, 5 days, 10 days, 20 days, 30 days, 40 days, 50 days, 75 days, 100 days, 150 days, 200 days, 250 days, 300 days, 350 days, 365 days, or ranges therebetween). In some embodiments, a luciferase enzyme variant described herein exhibits enhanced resistance to inhibition by L-luciferin and/or a racemic luciferin mix relative to a luciferase of SEQ ID NO: 1. In some embodiments, a luciferase of SEQ ID NO: 1 exhibits reduced activity relative to a luciferase enzyme variant described herein following storage in the presence of L-luciferin and/or a racemic luciferin mix for 1 to 365 days (e.g., 1 day, 2 days, 5 days, 10 days, 20 days, 30 days, 40 days, 50 days, 75 days, 100 days, 150 days, 200 days, 250 days, 300 days, 350 days, 365 days, or ranges therebetween).

In some embodiments, luciferase enzyme variants described herein are thermally stable when stored in the presence of luciferin (e.g., D-luciferin, racemic luciferin mix) and/or luciferin derivatives (e.g., fluoroluciferin, aminoluciferin, racemic luciferin, 5,5-disubstituted luciferin analogs, etc.). In some embodiments, a luciferase enzyme variant described herein exhibits less than 20% (e.g., 19%, 18%, 17%, 16%, 15%, 14%, 13%, 12%, 11%, 10%, 9%, 8%, 7%, 6%, 5%, 4%, 3%, 2%, 1%, or less, or ranges therebetween (e.g., 5% or less)) loss of activity when stored above 0° C. (e.g., 1° C., 2° C., 3° C., 4° C., 5° C., 6° C., 7° C., 8° C., 9° C., 10° C., 11° C., 12° C., 13° C., 14° C., 15° C., 16° C., 17° C., 18° C., 19° C., 20° C., 21° C., 22° C., 23° C., 24° C., 25° C., 26° C., 27° C., 28° C., 29° C., 30° C., 31° C., 32° C., 33° C., 34° C., 35° C., 36° C., 37° C., 38° C., 39° C., 40° C., or ranges therebetween) in the presence of luciferin (e.g., D-luciferin, racemic luciferin mix) and/or luciferin derivatives (e.g., fluoroluciferin, aminoluciferin, 5,5-disubstituted luciferin analogs, etc.) for 1 to 365 days (e.g., 1 day, 2 days, 5 days, 10 days, 20 days, 30 days, 40 days, 50 days, 75 days, 100 days, 150 days, 200 days, 250 days, 300 days, 350 days, 365 days, or ranges therebetween). In some embodiments, a luciferase enzyme variant described herein exhibits enhanced thermal stability in the presence of luciferin (e.g., D-luciferin, racemic luciferin mix) and/or luciferin derivatives (e.g., fluoroluciferin, aminoluciferin, 5,5-disubstituted luciferin analogs, etc.) relative to a luciferase of SEQ ID NO: 1.

In some embodiments, luciferase enzyme variants described herein are thermally stable in the presence of luciferin break-down products (e.g., dehydroluciferin) and/or break-down products of luciferin derivatives (e.g., fluorodehydroluciferin, aminodehydroluciferin, breakdown products of 5,5-disubstituted luciferin analogs, etc.). In some embodiments, a luciferase enzyme variant described herein exhibits less than 20% (e.g., 19%, 18%, 17%, 16%, 15%, 14%, 13%, 12%, 11%, 10%, 9%, 8%, 7%, 6%, 5%, 4%, 3%, 2%, 1%, or less, or ranges therebetween (e.g., 5% or less)) loss of activity when stored above 0° C. (e.g., 1° C., 2° C., 3° C., 4° C., 5° C., 6° C., 7° C., 8° C., 9° C., 10° C., 11° C., 12° C., 13° C., 14° C., 15° C., 16° C., 17° C., 18° C., 19° C., 20° C., 21° C., 22° C., 23° C., 24° C., 25° C., 26° C., 27° C., 28° C., 29° C., 30° C., 31° C., 32° C., 33° C., 34° C., 35° C., 36° C., 37° C., 38° C., 39° C., 40° C., or ranges therebetween) in the presence of luciferin break-down products (e.g., dehydroluciferin) and/or break-down products of luciferin derivatives (e.g., aminodehydroluciferin, fluorodehydroluciferin, breakdown products of 5,5-disubstituted luciferin analogs, etc.) for 1 to 365 days (e.g., 1 day, 2 days, 5 days, 10 days, 20 days, 30 days, 40 days, 50 days, 75 days, 100 days, 150 days, 200 days, 250 days, 300 days, 350 days, 365 days, or ranges therebetween). In some embodiments, a luciferase enzyme variant described herein exhibits enhanced thermal stability in the presence of luciferin breakdown products (e.g., dehydroluciferin) and/or break-down products of luciferin derivatives (e.g., aminodehydroluciferin, fluorodehydroluciferin, breakdown products of 5,5-disubstituted luciferin analogs, etc.) relative to a luciferase of SEQ ID NO: 1.

In some embodiments, luciferase enzyme variants described herein are thermally stable in the presence of L-luciferin and/or a racemic luciferin mix. In some embodiments, a luciferase variant described herein exhibits less than 20% (e.g., 19%, 18%, 17%, 16%, 15%, 14%, 13%, 12%, 11%, 10%, 9%, 8%, 7%, 6%, 5%, 4%, 3%, 2%, 1%, or less, or ranges therebetween (e.g., 5% or less)) loss of activity when stored above 0° C. (e.g., 1° C., 2° C., 3° C., 4° C., 5° C., 6° C., 7° C., 8° C., 9° C., 10° C., 11° C., 12° C., 13° C., 14° C., 15° C., 16° C., 17° C., 18° C., 19° C., 20° C., 21° C., 22° C., 23° C., 24° C., 25° C., 26° C., 27° C., 28° C., 29° C., 30° C., 31° C., 32° C., 33° C., 34° C., 35° C., 36° C., 37° C., 38° C., 39° C., 40° C., or ranges therebetween) in the presence of L-luciferin and/or a racemic luciferin mix for 1 to 365 days (e.g., 1 day, 2 days, 5 days, 10 days, 20 days, 30 days, 40 days, 50 days, 75 days, 100 days, 150 days, 200 days, 250 days, 300 days, 350 days, 365 days, or ranges therebetween). In some embodiments, a luciferase enzyme variant described herein exhibits enhanced thermal stability in the presence of L-luciferin and/or a racemic luciferin mix relative to a luciferase of SEQ ID NO: 1.

In some embodiments, luciferase enzyme variants described herein are thermally stable when incubated in the presence of luciferin. In some embodiments, a luciferase enzyme variant described herein exhibits less than 20% (e.g., 19%, 18%, 17%, 16%, 15%, 14%, 13%, 12%, 11%, 10%, 9%, 8%, 7%, 6%, 5%, 4%, 3%, 2%, 1%, or less, or ranges therebetween (e.g., 5% or less)) loss of activity when incubated above room temperature (e.g., 25° C., 26° C., 27° C., 28° C., 29° C., 30° C., 31° C., 32° C., 33° C., 34° C., 35° C., 36° C., 37° C., 38° C., 39° C., 40° C., 41° C., 42° C., 43° C., 44° C., 45° C., 46° C., 47° C., 48° C., 49° C., 50° C., or ranges therebetween) in the presence of luciferin for 1 to 100 minutes (e.g., 1 minute, 2 minutes, 5 minutes, 10 minutes 15 minutes, 20 minutes, 25 minutes, 30 minutes, 35 minutes, 40 minutes, 45 minutes, 50 minutes, 55 minutes, 60 minutes, 65 minutes, 70 minutes, 75 minutes, 80 minutes, 85 minutes, 90 minutes, 95 minutes, 100 minutes, or ranges therebetween). In some embodiments, a luciferase enzyme variant described herein exhibits enhanced thermal stability when incubated in the presence of luciferin relative to a luciferase of SEQ ID NO: 1.

In some embodiments, luciferase enzyme variants described herein are thermally stable when incubated in the presence of luciferin breakdown products (e.g., dehydroluciferin) and/or breakdown products of luciferin derivatives (e.g., aminodehydroluciferin, fluorodehydroluciferin, breakdown products of 5,5-disubstituted luciferin analogs, etc.). In some embodiments, a luciferase enzyme variant described herein exhibits less than 20% (e.g., 19%, 18%, 17%, 16%, 15%, 14%, 13%, 12%, 11%, 10%, 9%, 8%, 7%, 6%, 5%, 4%, 3%, 2%, 1%, or less, or ranges therebetween (e.g., 5% or less)) loss of activity when incubated above room temperature (e.g., 25° C., 26° C., 27° C., 28° C., 29° C., 30° C., 31° C., 32° C., 33° C., 34° C., 35° C., 36° C., 37° C., 38° C., 39° C., 40° C., 41° C., 42° C., 43° C., 44° C., 45° C., 46° C., 47° C., 48° C., 49° C., 50° C., or ranges therebetween) in the presence of luciferin break-down products (e.g., dehydroluciferin) and/or break-down products of luciferin derivatives (e.g., aminodehydroluciferin, fluorodehydroluciferin, breakdown products of 5,5-disubstituted luciferin analogs, etc.) for 1 to 100 minutes (e.g., 1 minute, 2 minutes, 5 minutes, 10 minutes 15 minutes, 20 minutes, 25 minutes, 30 minutes, 35 minutes, 40 minutes, 45 minutes, 50 minutes, 55 minutes, 60 minutes, 65 minutes, 70 minutes, 75 minutes, 80 minutes, 85 minutes, 90 minutes, 95 minutes, 100 minutes, or ranges therebetween). In some embodiments, a luciferase enzyme variant described herein exhibits enhanced thermal stability when incubated in the presence of luciferin break-down products (e.g., dehydroluciferin) and/or break-down products of luciferin derivatives (e.g., aminodehydroluciferin, fluorodehydroluciferin, breakdown products of 5,5-disubstituted luciferin analogs, etc.) relative to a luciferase of SEQ ID NO: 1.

In some embodiments, luciferase enzyme variants described herein are thermally stable when incubated in the presence of L-luciferin and/or a racemic luciferin mix. In some embodiments, a luciferase variant described herein exhibits less than 20% (e.g., 19%, 18%, 17%, 16%, 15%, 14%, 13%, 12%, 11%, 10%, 9%, 8%, 7%, 6%, 5%, 4%, 3%, 2%, 1%, or less, or ranges therebetween (e.g., 5% or less)) loss of activity when incubated above room temperature (e.g., 25° C., 26° C., 27° C., 28° C., 29° C., 30° C., 31° C., 32° C., 33° C., 34° C., 35° C., 36° C., 37° C., 38° C., 39° C., 40° C., 41° C., 42° C., 43° C., 44° C., 45° C., 46° C., 47° C., 48° C., 49° C., 50° C., or ranges therebetween) in the presence of L-luciferin and/or a racemic luciferin mix for 1 to 100 minutes (e.g., 1 minute, 2 minutes, 5 minutes, 10 minutes 15 minutes, 20 minutes, 25 minutes, 30 minutes, 35 minutes, 40 minutes, 45 minutes, 50 minutes, 55 minutes, 60 minutes, 65 minutes, 70 minutes, 75 minutes, 80 minutes, 85 minutes, 90 minutes, 95 minutes, 100 minutes, or ranges therebetween). In some embodiments, a luciferase enzyme variant described herein exhibits enhanced thermal stability when incubated in the presence of L-luciferin and/or a racemic luciferin mix relative to a luciferase of SEQ ID NO: 1.

In some embodiments, luciferase enzyme variants described herein are resistant to inhibition by one or more (e.g., 2, 3, 4, 5, 6, 7, 8, 9, 10, or more, or ranges therebetween) luciferin break-down products, luciferin reaction products, and other non-substrate (e.g., not a luciferase (e.g., firefly luciferase) substrate) luciferin derivatives, such as, but not limited to dehydroluciferin, aminodehydroluciferin, fluorodehydroluciferin, L-luciferin, oxoluciferin, fluorooxoluciferin, aminooxoluciferin, 5,5-disubstituted luciferin analogs, and the like.

In some embodiments, a luciferase enzyme variant described herein exhibits enhanced signal stability (e.g., as measured by the half-life of decay of the signal in a time-course (e.g., 10% increase, 20% increase, 30% increase, 40% increase, 50% increase, 60% increase, 70% increase, 80% increase, 90% increase, 2-fold increase, 3-fold increase, 4-fold increase, 5-fold increase, 6-fold increase, 7-fold increase, 8-fold increase, 9-fold increase, 10-fold increase, 20-fold increase, 50-fold increase, 100-fold increase, 1000-fold increase, or more, or ranges therebetween)) when compared to a reference luciferase (e.g., SEQ ID NO: 1).

In some embodiments, a luciferase enzyme variant described herein exhibits enhanced apparent signal stability (e.g., as measured by the half-life of decay of the signal in a time-course (e.g., 10% increase, 20% increase, 30% increase, 40% increase, 50% increase, 60% increase, 70% increase, 80% increase, 90% increase, 2-fold increase, 3-fold increase, 4-fold increase, 5-fold increase, 6-fold increase, 7-fold increase, 8-fold increase, 9-fold increase, 10-fold increase, 20-fold increase, 50-fold increase, 100-fold increase, 1000-fold increase, or more, or ranges therebetween)) in the presence of an inhibitor when compared to its stability in the absence of the inhibitor. In some embodiments, the inhibitor is one or more of a dehydroluciferin (e.g., dehydroluciferin, dehydrooxoluciferin, dehydroaminoluciferin, and dehydroaminooxoluciferin).

In some embodiments, a luciferase enzyme variant described herein exhibits an increase in enhancement of apparent signal stability (e.g., as measured by the half-life of decay of the signal in a time-course (e.g., 10% increase, 20% increase, 30% increase, 40% increase, 50% increase, 60% increase, 70% increase, 80% increase, 90% increase, 2-fold increase, 3-fold increase, 4-fold increase, 5-fold increase, 6-fold increase, 7-fold increase, 8-fold increase, 9-fold increase, 10-fold increase, 20-fold increase, 50-fold increase, 100-fold increase, 1000-fold increase, or more, or ranges therebetween)) in the presence of an inhibitor when compared to its stability in the absence of the inhibitor, when compared to the signal stability enhancement in the presence of the inhibitor of a reference luciferase (e.g., SEQ ID NO: 1).

In some embodiments, provided herein are nucleic acids (e.g., DNA, RNA, etc.) encoding the luciferase enzyme variant polypeptides described herein, including SEQ ID NOs: 69-134, which encode the polypeptide sequences of SEQ ID NOs: 2-124. In some embodiments, provided herein are vectors comprising nucleic acids (e.g., DNA, RNA, etc.) encoding the luciferase enzyme variant polypeptides described herein. In some embodiments, provided herein are cells expression the luciferase enzyme variant polypeptides described herein. In some embodiments, provided herein are fusion proteins comprising the luciferase enzyme variant polypeptides described herein.

In some embodiments, to measure luminescence and thereby determine the activity of a particular luciferase enzyme variant (or reagent composition comprising a luciferase enzyme variant), the relative light unit (RLU) value generated by the luciferase enzyme variant reaction at a time point of interest after the reagent composition is combined with a sample may be measured. In some embodiments, the relative light output may be compared to a control value (e.g., to determine the stability of the activity of the luciferase).

Assay Components, Kits, and Formulations

In some embodiments, in addition to a luciferase enzyme variant and/or a luciferin analog described herein (and potentially luciferin analog degradation products), reagent compositions further comprise additional components for storage (e.g., for enzyme stability), handling (e.g., to facilitate dispensing of the reagent composition), and/or assay performance. In some embodiments, a reagent composition additional comprises salts or metal ions (e.g., Me), detergents, buffers, etc. In some embodiments, additional components are part of the reagent composition and stored in the same container as the luciferase enzyme variant and luciferin. In some embodiments, a reagent composition (e.g., comprising luciferase enzyme variant and luciferin) is provided as part of a kit, the kit comprising additional components/reagents that are stored in a separate contained from the reagent composition.

In some embodiments, a kit or reagent composition comprises a luciferase enzyme variant described herein, and thiourea and/or azathiothymidine (ATT), or one or more analogs or derivatives of thiourea and ATT. In some embodiments, a kit or reagent composition comprises a luciferase enzyme variant described herein and a 5,5-disubstituted luciferin analog. In some embodiments, a kit or reagent composition comprises a luciferase enzyme variant described herein, ATT, and a 5,5-disubstituted luciferin analog. In some embodiments, a kit or reagent composition comprises a luciferase enzyme variant described herein, ATT, a 5,5-disubstituted luciferin analog, and Me.

In some embodiments, a kit or reagent composition comprises a luciferase enzyme variant described herein, D-luciferin, and ATT. In some embodiments, a kit or reagent composition comprises a luciferase enzyme variant described herein, D-luciferin, and a 5,5-disubstituted luciferin analog. In some embodiments, a kit or reagent composition comprises a luciferase enzyme variant described herein, D-luciferin, ATT, and a 5,5-disubstituted luciferin analog. In some embodiments, a kit or reagent composition comprises a luciferase enzyme variant described herein and a racemic luciferin mixture. In some embodiments, a kit or reagent composition comprises a luciferase enzyme variant described herein and a racemic luciferin mixture. In some embodiments, a kit or reagent composition comprises a luciferase enzyme variant described herein, a 5,5-disubstituted luciferin analog, and a racemic luciferin mixture. In some embodiments, a kit or reagent composition comprises a luciferase enzyme variant described herein, ATT, and a racemic luciferin mixture. In some embodiments, a kit or reagent composition comprises a luciferase enzyme variant described herein, ATT, a 5,5-disubstituted luciferin analog, and a racemic luciferin mixture. In any of the aforementioned embodiments, luciferin may be replaced by other luciferin substrates (e.g., aminoluciferin, fluoroluciferin, etc.), and/or a 5,5-disubstituted luciferin analog may be replaced by 5,5-disubstituted luciferin analog degradation products.

In some embodiments, a kit or reagent composition comprises a luciferase enzyme variant described herein, luciferin (e.g., D-luciferin), and one or more 5,5-disubstituted luciferin analogs. In some embodiments, inclusion of one or more 5,5-disubstituted luciferin analogs in the kit or reagent composition provides enhancement of one or more of luminescent signal duration, luminescent signal intensity, apparent enzyme stability (e.g., thermostability), and/or storage stability. In some embodiments, the enhanced activity of the luciferase enzyme variant to the one or more 5,5-disubstituted luciferin analogs provides a reagent composition or kit with one or more of enhanced luminescent signal duration, luminescent signal intensity, apparent enzyme stability (e.g., thermostability), and/or storage stability while providing sufficient signal to be useful in assays and other applications.

In some embodiments, a kit or reagent composition comprises one or more suitable buffers (e.g., Reagent Detection Buffer of Bright-Glo™ Buffer). Any buffers that maintain suitable pH for the working solution and do not significantly interfere with the luciferase-luciferin reaction are contemplated. The preferred pH range is between about pH 4.5 and about pH 9.0 (e.g., about pH 6.0 and about pH 8.0 (e.g., 6.0, 6.2, 6.4, 6.6, 6.8, 7.0, 7.2, 7.4, 7.6, 7.8, 8.0, and ranges therebetween)). Suitable buffers include MES, citrate buffers, phosphate buffered saline (PBS), Tris-N-(2-Hydroxyethyl)piperazine-N'-(2-ethanesulfonic acid) (HEPES), piperazine-1,4-bis(2-ethanesulfonic acid) (PIPES), borate, and any other buffer known to those of skill in the art may be suitable. Selection of appropriate buffers depends on pH buffering capacity and interaction with the luciferase-luciferin reaction.

In some embodiments, a kit or reagent composition comprises one or more defoamers. Defoaming agents are desirable to prevent foam from interfering with the detection of bioluminescence, especially in applications that quantify luminescence. Defoaming agents, such as MAZU, may be organic or silicone based. Selection of defoamers depends on their ability to eliminate foam without interfering with the luciferase-luciferin reaction.

In some embodiments, a kit or reagent composition comprises magnesium. The luciferase-luciferin reaction is dependent not only on ATP, but also on magnesium ions. In some embodiments, to ensure luciferase activity, magnesium is exogenously supplied. In addition to magnesium sulfate, other salts of magnesium are contemplated such as magnesium chloride, magnesium gluconate, magnesium acetate, magnesium bromide, magnesium carbonate, or any magnesium complex that dissociates in the reagent composition or in the sample to yield $Mg^{2+}$ ions available to the luciferase and does not interfere with the luciferase-luciferin reaction. In some embodiments, other cations are provided in addition to or in place of magnesium such as calcium and manganese. In some embodiments, the endogenous magnesium of the sample is sufficient to allow the luciferase-luciferin bioluminescence in the presence of ATP; in such embodiments, magnesium may not be included in a kit or reagent composition.

In some embodiments, a kit or reagent composition comprises a component containing one or more ATPase inhibitors within a solution optionally containing other functional components, such as buffers, defoamers, enzyme stabilizers, and the like. This component may be supplied as a working solution or as a concentrate. In some embodiments, an ATPase inhibitor is a detergent with a charged group (e.g., cationic detergent (e.g., DTAB (dodecyltrimethylammonium bromide), Benzalkonium Chloride, CTAB (cetyltmethylammonium), BDDABr (benzyldimethyldodecylammonium bromide), etc.), anionic detergent (e.g., deoxycholate or SDS), or zwitterionic detergent (e.g., sulfobetaine 3-10), etc.). Such inhibitors prevent ATPases in a sample from processing ATP to adenosine diphosphate (ADP) and adenosine monophosphate (AMP), for example, before the luciferase is able to utilize the ATP in the luciferase-luciferin reaction. ATPase inhibitors may inactivate ATPases directly or indirectly. They may bind to ATPases, either in the active sites, thus preventing substrate binding, or denature ATPases, such as by denaturing detergents, or they may selectively sequester ATPases from their substrates.

In some embodiments, a kit or reagent composition comprises a component containing one or more inhibitors of ATP-generating enzymes. In some samples, enzymes such as kinases may be active allowing for continued production of ATP. Because the ATP concentration is determined at a specific time such enzymatic activity may result in an overestimation of the ATP concentration. In some embodiments, to counter such ATP-generating activity, reagent compositions and/or kits herein comprise inhibitors of ATP production. Examples of useful compounds include NaF, which is useful at concentrations of at least 1 mM, 2 mM, 5 mM, 10 mM, 20 mM, 50 mM, 100 mM, or more or ranges therebetween. Any such inhibitor may be used, however, if it does not adversely affect luciferase so as to take it outside the utility of embodiments herein. Other inhibitors of ATP-generating enzymes include, but are not limited to, vanadate, paranitrophenylphosphate, and dichloroacetic acid.

In some embodiments, a kit or reagent composition comprises a cell lysing agent and/or ATP-extraction agent. In embodiments in which a sample comprises cells, and intracellular ATP is desired for detection/quantification, reagents may be provided to lyse cells and/or liberate ATP from cells. In some embodiments, to free ATP sequestered within a cell and/or to lyse cells in a sample, cell lysing agents, such as non-ionic detergents, are included. Any cell lysing agent is contemplated including other non-ionic detergents (e.g., Triton series detergents), cationic, anionic, and zwitterionic detergents, bile salts, chaotropes, and any other agent that disrupts cellular membranes including bacterial toxins such as oxylysins. Alternatively, any agent that allows for ATP extraction from a cell is contemplated (e.g., CTAB). Agents that allow for ATP extraction from a cell include detergents present at a concentration that permeabilizes the cell membrane allowing for ATP within the cell to leach into the surrounding media, but not present at such a concentration that produces a cell lysate.

In some embodiments, a kit or reagent composition comprises one or more stabilizing agents. In some embodiments, the stabilizing agent can be any compound that stabilizes the luciferase from degradation. Suitable stabilizing agents include proteins (e.g., bovine serum albumin, gelatin, etc.), detergents (e.g., non-ionic detergents, such as THESIT), etc.

In some embodiments, other agents may be included a kit or reagent composition herein. For example, a kit or reagent composition may include substances that are known to enhance the duration of luminescence resulting from a luciferase reaction, such as co-enzyme A (CoA), thiol reagents such as dithiothreitol, β mercaptoethanol, and metal ion chelators, such as EDTA, to prolong the signal, protease inhibitors, or salts (e.g., NaCl, KCl, $Na_2SO_4$, $NAHCO_3$, $NaH_2PO_4$, etc.).

In some embodiments, a reagent composition and/or other components of a kit are contained in one or more containers or vessels. In some embodiments, the components of a reagent composition are contained within a single container or vessel. In some embodiments, a kit may comprise multiple containers or vessels containing the reagent composition. In some embodiments, a kit comprises one or more containers or vessels containing reagents other than the reagent composition (see above). In some embodiments, components and reagents included in a kit are supplied in containers of any sort such that the life of the different components are preserved and are not adsorbed or altered by the materials of the container. Containers or vessels may comprise or consist of any suitable material such as glass, organic polymers, polycarbonate, polystyrene, etc., ceramic, metal, or any other material typically employed to hold reagents. Examples of suitable containers include ampules, bottles, envelopes, test tubes, vials, flasks, bottles, syringes, or the like.

In some embodiments, kits comprise, and/or reagent compositions are provided with, appropriate instruction materials. Instructions may be printed on paper or other substrate, and/or may be supplied as an electronic-readable medium, such as a floppy disc, CD-ROM, DVD-ROM, Zip disc, videotape, audio tape, etc. Detailed instructions may not be physically associated with the kit; instead, a user may be directed to an internet web site specified by the manufacturer or distributor of the kit, or supplied as electronic mail. In some embodiments, the instructions instruct the user to combine reagent composition (e.g., comprising luciferase and luciferin) with a sample to detect or quantify ATP.

In some embodiments, a reagent composition is provided as a liquid reagent. In some embodiments, by providing a stable luciferase enzyme variant described herein and luciferin in a single premixed liquid reagent, variability introduced by rehydrating a lyophilized reagent is eliminated. In other embodiments, a reagent composition is provided in lyophilized form. In some embodiments, other components of a kit herein may be provided as one or multiple liquid or dried compositions.

In some embodiments, a reagent composition for a bioluminescent assay includes a luciferase enzyme variant capable of producing an increased bioluminescent signal in the presence of a 5,5-disubstituted luciferin analog compared to a bioluminescent signal produced by a luciferase polypeptide of SEQ ID NO: 1 in the presence of the 5,5-disubstituted luciferin analog and a 5,5-disubstituted luciferin analog. In some embodiments, the reagent composition includes magnesium. In some embodiments, the reagent composition includes one or more additional components selected from the group consisting of: a buffer, a defoamer, an ATPase inhibitor, L-luciferin, azathiothymidine, an enzyme stabilizer, a detergent, an inhibitor of ATP-generating enzymes, a cell lysing agent, an ATP-extraction agent, co-enzyme A, a thiol reagent, a metal ion chelator, a protease inhibitor, and a salt. In accordance with these embodiments, the buffer is selected from Detection Reagent Buffer and Bright-Glo™ Buffer.

In some embodiments, the reagent composition is included in a kit as described herein. In some embodiments, the kit includes instructions for performing a bioluminescent assay such as, but not limited to, an assay for ATP detection and/or quantification, an assay for measuring caspase activity, or an assay for measuring kinase activity. In some embodiments, the kit includes a luciferase enzyme variant capable of producing an increased bioluminescent signal in the presence of a 5,5-disubstituted luciferin analog compared to a bioluminescent signal produced by a luciferase polypeptide of SEQ ID NO: 1 in the presence of the 5,5-disubstituted luciferin analog and a 5,5-disubstituted luciferin analog.

Bioluminescent Assays and Methods

Although the luciferase enzyme variants and reagent compositions (e.g., comprising luciferase variants and 5,5-disubstituted luciferin analogs) described herein are not limited to use in any particular method or application, due to their stability and activity, including in the presence of degradation products, the luciferase enzyme variants and reagent compositions described herein are particularly useful for the detection of ATP in a sample and for detecting or quantifying target enzyme activity.

Because the luciferase-luciferin reaction is ATP-dependent, the luciferase enzyme variants and reagent compositions described herein find use in assays for to detect and/or quantify ATP. The luciferase-luciferin reaction allows ATP to be detected in a sample containing as little as $10^{-16}$ moles of ATP or less. In some embodiments, provided herein are methods, compositions and kits that are used to effectively and accurately detect and quantify cellular ATP levels. In some embodiments, the luciferase enzyme variants and reagent compositions described herein find use in the detection of ATP on surfaces, in non-cellular samples (e.g., water), for hygiene monitoring, etc.

In some embodiments, methods comprise the addition of a single reagent composition that comprises a luciferase enzyme variant described herein and luciferin (and optionally 5,5-disubstituted luciferin analogs) to a sample (e.g., a sample comprising or suspected of possibly comprising ATP) and detecting luminescence. In some embodiments, additional components and/or reagents (see above) are included with the reagent composition or added separately (e.g., a kinase inhibitor, a compound that prevents accumulation of ATP, a cell-lysing agent (e.g., a polyoxyethylene such as THESIT), an ATP extracting agent, magnesium, a buffer, salts, etc.). In some embodiments, the inclusion of the luciferase enzyme variant described herein and luciferin in a single reagent speeds ATP detection, simplifies assays and handling, and/or increases reproducibility.

As discussed herein, the methods, compositions and kits herein are particularly useful for the qualitative or quantitative detection of ATP (or ATP an analogue which can function as a luciferase substrate) in a sample. In some embodiments, a simple qualitative experiment in which luminescence is generated in a sample using a reagent composition (e.g., comprising luciferase enzyme variants and 5,5-disubstituted luciferin analogs described herein) indicates the presence of ATP. In some embodiments, an assay is provided in which the amount of ATP in a sample is quantitated. ATP may be detected (e.g., qualitatively) and/or quantitated as a single time-point, at multiple time-points, or in real time using the luciferases, reagent compositions, and/or kits herein.

In some embodiments, a sample is anything that contains or is suspected of containing ATP or a suitable ATP analogue, such as cell lysates, intact cells, biopsies, foods, beverages, water, swabs wiped on surfaces such as those of animals, plants, or inanimate objects, and the like. In some embodiments, the sample is one or more of a cell lysate sample, a cell-free preparation sample, or a purified enzyme formulation sample. In other embodiments, the sample is one or more of an environmental sample, a soil sample, a water sample, an industrial chemical sample, a forensic sample, a food-based sample, a liquid sample, a beverage-based sample, or a biochemical sample.

Other examples of samples include compositions of a known ATP concentration. Cells or cell lysates may be from any organism, prokaryotic or eukaryotic. Samples can also include preparations of purified enzymes (e.g., free of cellular components). Eukaryotic cells may be from plants, animals, fungi, insects, etc. or cultured cells from such organisms. These examples are furnished only as examples and are not meant to be limiting.

A cell lysate comprises cellular components that are no longer organized into a recognizable intact cellular architecture. Cell lysates may have soluble and insoluble components, either of which may be removed before using the lysate. Lysates may be prepared by any means, including physical disruption using sonication, a dounce, mortar and pestle, freeze-thaw cycling, or any other device or process that destroys the physical integrity of cells; or lysis by detergents, such as those in which luciferase activity is maintained, such as zwitterionic and nonionic detergents, or cationic detergents DTAB or CTAB. Preferably, the cell lysate is produced in such a way that the integrity of the ATP concentration is preserved at the time the cells are harvested.

In some embodiments, to accurately detect ATP in a sample, enzymes that would degrade cellular ATP or those that would generate ATP are preferably inhibited or removed. Inhibitors of ATP-generating enzymes, those enzymes that have as a product or by-product ATP, such as the activity of kinases, may be incorporated into the reagent composition (e.g., comprising the luciferase variant and luciferin analogs) or into a kit comprising a reagent composition.

The luciferases, reagent compositions, methods, and kits herein permit a user to quantify the amount of ATP in a sample by quantifying the amount of luminescence. In some embodiments, the luciferase variant and luciferin analogs (in a single composition) are applied to a test sample of interest. In some embodiments, the luciferase variant and luciferin analogs (in a single composition) are also applied to a sample containing known amounts of ATP (control). The magnitude of the signal generated from the test sample correlates to the concentration of ATP in the sample. In some embodiments, the magnitude of the luminescent signal from the sample of unknown ATP concentration is correlated to signal generated either by internal controls (the addition of a known amount of ATP to a sample and measuring the subsequent luminescence) or external standard curves generated by measuring the luminescence of several samples of known ATP concentrations and plotting them graphically.

In some embodiments, an assay system for detecting or quantifying ATP in a sample includes a reagent composition comprising a luciferase enzyme variant capable of producing an increased bioluminescent signal in the presence of a 5,5-disubstituted luciferin analog compared to a bioluminescent signal produced by a luciferase polypeptide of SEQ ID NO: 1 in the presence of the 5,5-disubstituted luciferin analog, a 5,5-disubstituted luciferin analog, and a sample comprising or suspected of comprising ATP. In some embodiments, the assay system includes a device for the detection and or measurement of bioluminescence.

In some embodiments, assays and methods of the present disclosure include a method of detecting or quantifying ATP in a sample. In accordance with these embodiments, the method includes adding any of the reagent compositions discussed herein to the sample comprising or suspected of comprising ATP, and detecting or quantifying the bioluminescent signal.

In some embodiments, the present disclosure includes assay systems for detecting or quantifying target enzyme activity in a sample. In accordance with these embodiments, the assay system includes a reagent composition comprising a luciferase enzyme variant capable of producing an increased bioluminescent signal in the presence of a 5,5-disubstituted luciferin analog compared to a bioluminescent signal produced by a luciferase polypeptide of SEQ ID NO: 1 in the presence of the 5,5-disubstituted luciferin analog, a 5,5-disubstituted luciferin analog, and a sample comprising or suspected of comprising a target enzyme. In some embodiments, the assay system includes one or more 5,5-disubstituted luciferin analogs that are conjugated to a substrate of the target enzyme. In accordance with these embodiments, the target enzyme is a protease, a caspase, a kinase, a cytochrome 450 (CYP450), or a monoamine oxidase. In some embodiments, the assay system further includes a device for the detection and or measurement of bioluminescence.

In some embodiments, assays and methods of the present disclosure include a method of detecting or quantifying target enzyme activity in a sample. In accordance with these embodiments, the method includes adding any of the reagent compositions discussed herein to the sample comprising or suspected of comprising target enzyme activity and detecting or quantifying the bioluminescent signal.

Luminescence of a thermostable luciferase variant of Ppe (SEQ ID NO: 1) and luciferase enzyme variants described herein (e.g., variants of SEQ ID NO: 1) can be measured by expressing the enzyme in cells such as *E. coli* and growing individual colonies on agar plates. The colonies on agar plates can then be sprayed with luciferin and/or luciferin analogs and luminescence visualized by eye or with optical device such as a CCD camera. Pro-luciferin versions of luciferin analogs can also be utilized in assays including enzymes that activate the pro-luciferin by degrading it to separate the modification moiety from the luciferin or luciferin analog. These assays include, but are not limited to, Caspase and β-galactosidase (see, e.g., FIGS. 27A-27B and 28A-28B). In some embodiments, assaying enzyme activity with these methods can be used to identify and/or detect the presence of various pathogens.

EXAMPLES

It will be readily apparent to those skilled in the art that other suitable modifications and adaptations of the methods of the present disclosure described herein are readily applicable and appreciable, and may be made using suitable equivalents without departing from the scope of the present disclosure or the aspects and embodiments disclosed herein. Having now described the present disclosure in detail, the same will be more clearly understood by reference to the following examples, which are merely intended only to illustrate some aspects and embodiments of the disclosure, and should not be viewed as limiting to the scope of the disclosure. The disclosures of all journal references, U.S. patents, and publications referred to herein are hereby incorporated by reference in their entireties.

The present disclosure has multiple aspects, illustrated by the following non-limiting examples.

Activity of Luciferin Analogs

The luciferin analog compounds of the present disclosure (e.g., as described in U.S. patent application Ser. No. 15/829,581/PCT Application No. PCT/US2017/064284, which are herein incorporated by reference in its entirety) were tested to determine their activities as substrates for various luciferase enzymes including Click Beetle Green luciferase, Click Beetle Red luciferase, a thermostable luciferase variant of Ppe variant of SEQ ID NO: 1, and Firefly luciferase. A 0.05 mg/mL solution of each enzyme was prepared in BRIGHT-GLO™ assay buffer (Promega E263A) with 3 mM ATP. 3× serial dilutions of each enzyme were then prepared in BRIGHT-GLO™ assay buffer with 3 mM ATP, and 300 µL of each stock was serially diluted into 700 µL of buffer. A solution of each substrate (0.5 mM) was prepared in luciferin free water, and 50 of each substrate solution was combined with 50 µL of the enzyme dilution. Samples were incubated for one minute at room temperature, and luminescence measured on GLOMAX®-Multi+ plate luminometer. The enzymes tested (Click Beetle Green, Click Beetle Red, a thermostable luciferase variant of Ppe variant of SEQ ID NO: 1, and Firefly luciferase) were able to utilize the disclosed dimethyl substrates to produce light. In these tests, the Click Beetle enzymes produced stronger signals utilizing the dimethyl substrates than the thermostable luciferase variant of Ppe (SEQ ID NO: 1) and the Firefly luciferases.

Further tests were conducted at various substrate concentrations in the presence of sub-saturating D-Luciferin as a means to compare the binding affinity of the substrates. Solutions of 0.005 mg/ml Click Beetle-Green luciferase (CBG) or a thermostable luciferase variant of Ppe (SEQ ID NO: 1) were prepared in Bright-Glo™ assay buffer (Promega E263A) with 3 mM ATP. A 2 mM solution of each substrate was then prepared in water containing D-Luciferin (sub-saturating). In some cases, the substrate included racemic luciferin (D/L mixture). Each substrate was two-fold serially diluted in luciferin free water. A sample of 50 µL of each substrate dilution was combined with 50 µL of the enzyme solution. Samples were incubated at room temperature for one minute, and luminescence was measured on a GLOMAX® Multi+ plate luminometer. Substrates that have larger side chains at the 5,5 position have higher apparent RLUmax values which indicates that they are less inhibitory to D-Luciferin compared to smaller 5,5 disubstituted side chains. The apparent $K_m$ values suggest that analogs bearing smaller 5,5 position side chains bind the luciferase enzyme more tightly in the presence of D-luciferin compared to the larger 5,5 position substitutions.

The activities of the luciferin analog compounds at various pH were also tested. A stock buffer containing 25 mM of one of the following buffers: Citrate, MES, PIPES, HEPES, and TAPS was prepared, which also contained 0.5% (v/v) Tergitol, 0.05% Mazu DF204, and 10 mM $MgSO_4$. The buffers were aliquoted, and NaOH was added at various amounts to achieve a pH series. The accurate pH for each solution was determined by a pH meter. ATP (1 mM) and Click Beetle Green luciferase (CBG, 0.01 mg/mL) were added to each buffer in the pH series. Racemic mixtures of each dimethyl substrate (0.2 mM) were prepared in luciferin free water. In triplicate, each diluted substrate (50 uL) and each buffer in the pH series (50 uL) were combined, and the luminescence was measured using GLOMAX®-Multi+ plate luminometer immediately (t=0) and after a 15-minute incubation at room temperature. The results showed that the racemic mixtures of dimethyl substrates are active luciferase substrates over a pH range from about pH 5.6 to about pH 8.3. Thus, the disclosed compounds, in both L and D forms, may be utilized by firefly luciferases or click beetle luciferase to produce bioluminescence over a broad range of pH.

To determine if luciferin analogs with substitutions at the 5,5 position could be substrates for the thermostable luciferase variant of Ppe variant of SEQ ID NO: 1, tests were performed with analogs containing various disubstitutions of alkyl groups and closed ring structures in luminescence assays. A solution of 0.005 mg/ml the thermostable luciferase variant of Ppe (SEQ ID NO: 1) prepared in 1×TBS+1% Prionex was combined with 0.5 mM ATP in Bright-Glo™ assay buffer (Promega E263A). All substrates were diluted separately in DMSO to 20 mM. After a 30-minute incubation at room temperature, diluted substrate was added to 1 mM final concentration in the reaction and mixed by pipetting. Reactions were further incubated at room temperature for 1 minute, and luminescence measured on a GLOMAX® Multi+ plate luminometer. Several of the luciferin analogs with larger substitutions at the 5,5 position such as cyclohexyl (CS0392), dibenzyl (CS0396), and diethyl (CS0388) all showed measurable luminescence values, demonstrating that the thermostable luciferase variants of the Ppe variant (SEQ ID NO: 1) can utilize them as substrates.

Active Site-Saturation Screen for Luciferase Enzyme Variants

Figure 3:
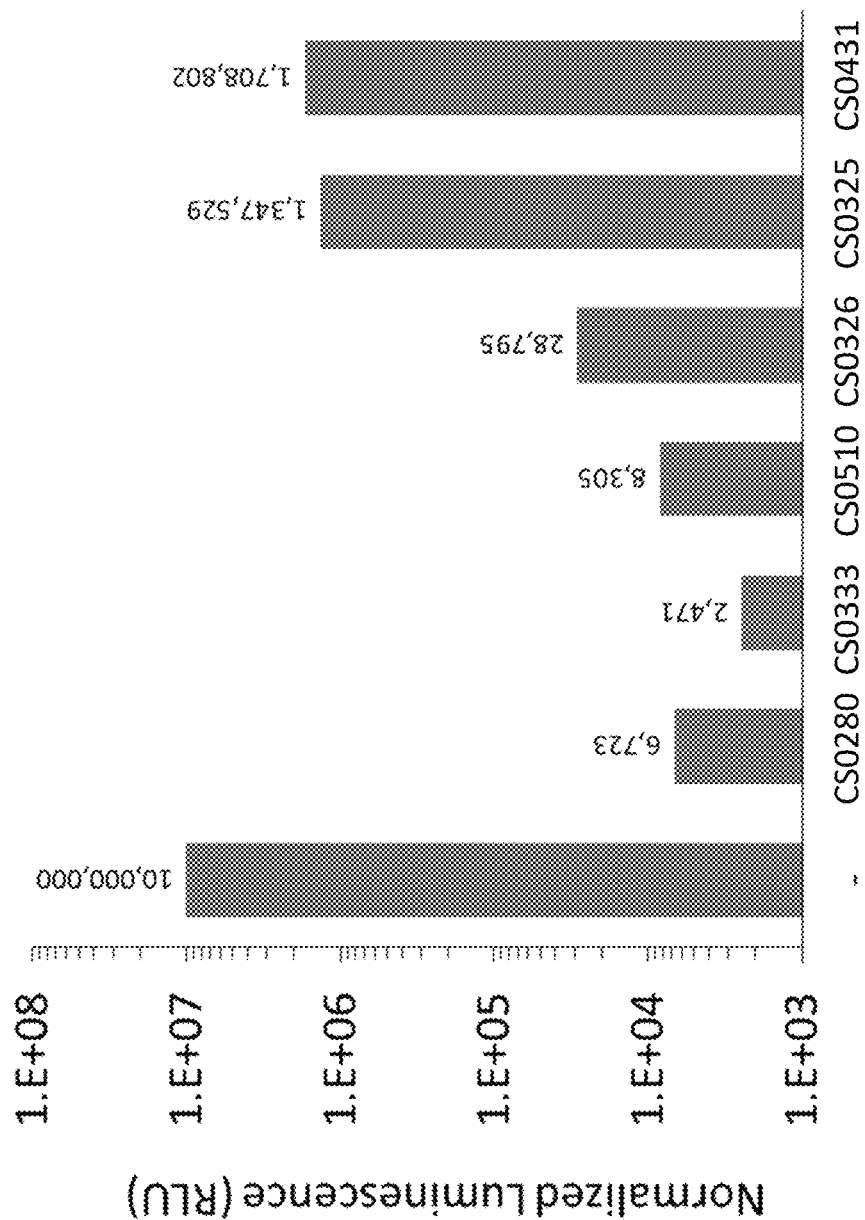
FIG. 3 includes a representative graph of the results of a competitive inhibition assay, in which luciferin analogs are competing with racemic luciferin, to identify luciferin analogs with high affinity for a luciferase polypeptide (SEQ ID NO: 1).

FIG. 3 includes a representative graph of the results of a competitive inhibition assay to identify luciferin analogs with high affinity for a thermostable luciferase variant of Ppe variant (SEQ ID NO: 1). More specifically, FIG. 3 includes normalized luminescence of the thermostable luciferase variant of Ppe variant (SEQ ID NO: 1) with D/L-luciferin in the absence or presence of luciferin analogs CS0280, CS0333, CS0510, CS0326, CS0325, and CS0431. The reagent composition for these bioluminescent experiments included 0.005 mg/mL the thermostable luciferase variant of Ppe variant of SEQ ID NO: 1, 0.5 mM ATP, and 100 nM $LH_2$ in Bright-Glo™ buffer (Promega E263A), and this was spiked with either 0 or 1 mM of 5,5-disubstituted luciferin analogs.

Tests of the thermostable luciferase variant of Ppe variant of SEQ ID NO: 1 with 5,5-disubstituted luciferin analogs showed little luminescence, and in the presence of luciferin, reduced light output, indicating competitive inhibition of the a thermostable luciferase variant of Ppe variant of SEQ ID NO: 1. Based on the results of these experiments, the following 5,5-disubstituted luciferin analogs were chosen for further experimentation based on their affinity for the active site of the thermostable luciferase variant of Ppe variant of SEQ ID NO: 1: CS0280 (5,5-dimethyl), C S0333 (5,5-cyclopropyl), and CS0326 (5,5-cyclobutyl). These 5,5-disubstituted luciferin analogs were used to generate luciferase enzyme variants of SEQ ID NO: 1 having improved or enhanced characteristics for use in bioluminescent assays.

FIG. 4 includes representative images of the active site of the luciferase of SEQ ID NO: 1 (left), a table containing various amino acid substitutions at the positions indicated (middle), and a graph indicating the activity levels of each of the variants tested (right). Twelve positions on the thermostable luciferase variant of Ppe variant (ATG-2287; SEQ ID NO: 1) were selected for site-saturation screening due to their proximity to the active site. Variants were generated using all 20 amino acids. Libraries were screened in E. coli lysates with 100 nM D/L-luciferin with ATP in Detection Reagent (Promega, V8921). As shown, mutations at positions 244, 249, 337, and 339 showed improvements in brightness.

Figure 5:
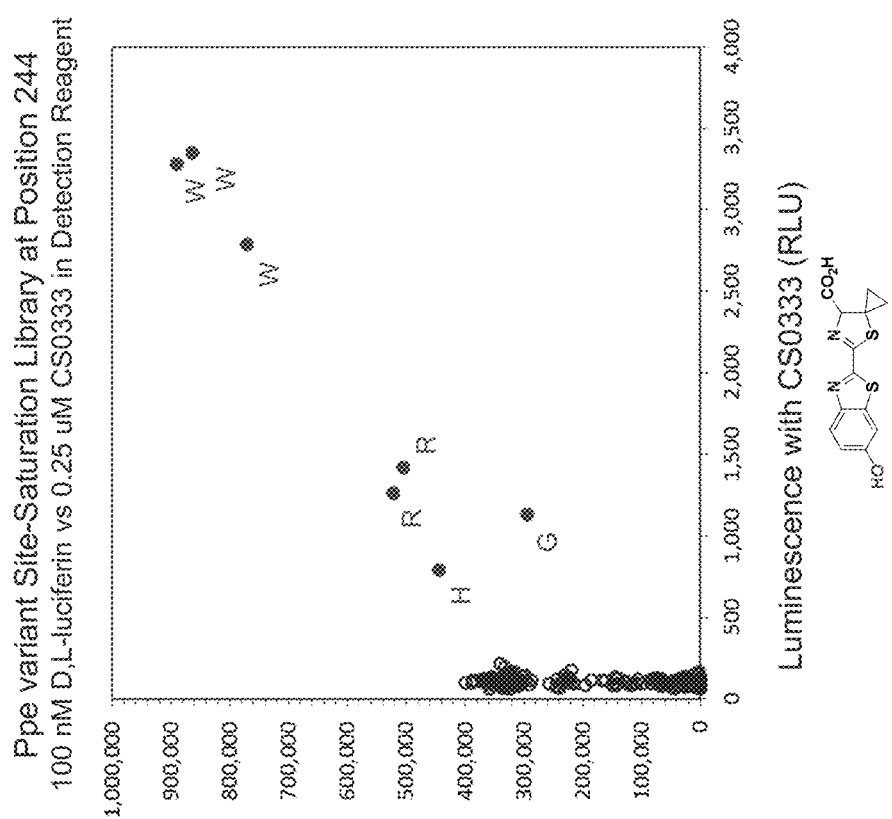
FIG. 5 includes a representative table (left) and corresponding graph (right) indicating activity levels of luciferase variants tested with CS0333 and their relative amino acid substitutions at position 244 of SEQ ID NO: 1.

FIG. 5 includes a representative table (left) and corresponding graph (right) indicating activity levels of luciferase enzyme variants tested with CS0333 and their relative amino acid substitutions. Based on structural analysis of the L. cruciata luciferase, a close homolog of the thermostable luciferase variant of Ppe (SEQ ID NO: 1), site-saturation mutagenesis libraries were constructed targeted residues near the active site of the enzyme where luminogenic substrate (e.g., 5,5-disubstituted luciferin analogs) is predicted to be bound. The reagent composition for these experiments included 100 nM D, L-luciferin or 0.25 uM CS0333 in Detection Reagent buffer. The site-saturation library at position 244 was screened in E. coli lysates with CS0333 with ATP in Detection Reagent buffer, and mutations with improved activity were sequenced. As shown, amino acid substitutions of Trp, Arg, and Gly at position 244 (H244W, H244R, H244G) had improved activity over His found in the thermostable luciferase variant of Ppe variant (SEQ ID NO: 1). This resulted in the ATG-2889 (H244W) variant of the thermostable luciferase variant of Ppe variant of SEQ ID NO: 1 (SEQ ID NO: 5).

Figure 6A:
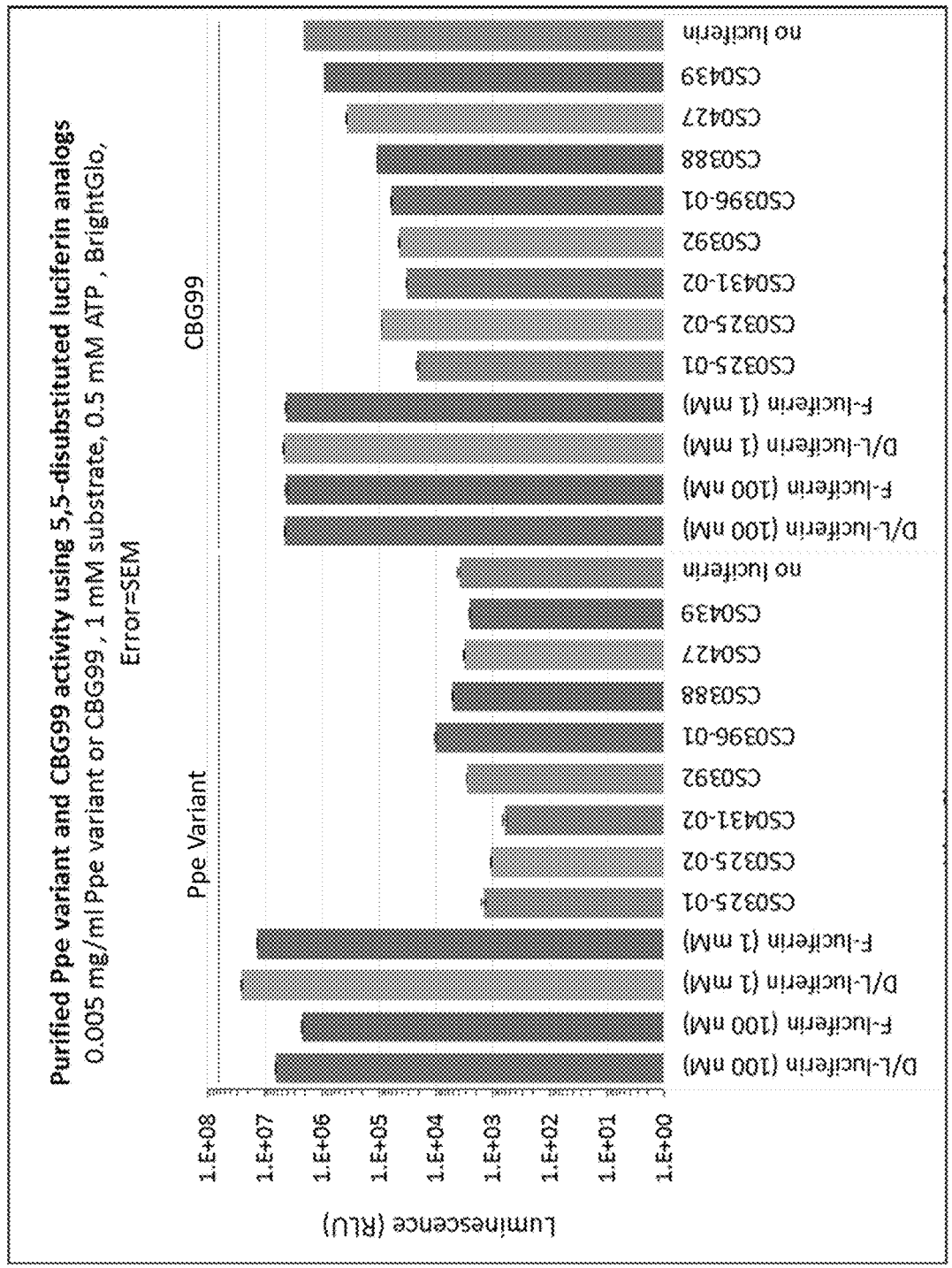
FIGS. 6A-6C include representative graphs comparing the activities of a thermostable variant of Ppe (SEQ ID NO: 1) and Click Beetle Green (CBG99) in the presence of 5,5-disubstituted luciferin analogs.
Figure 6B:
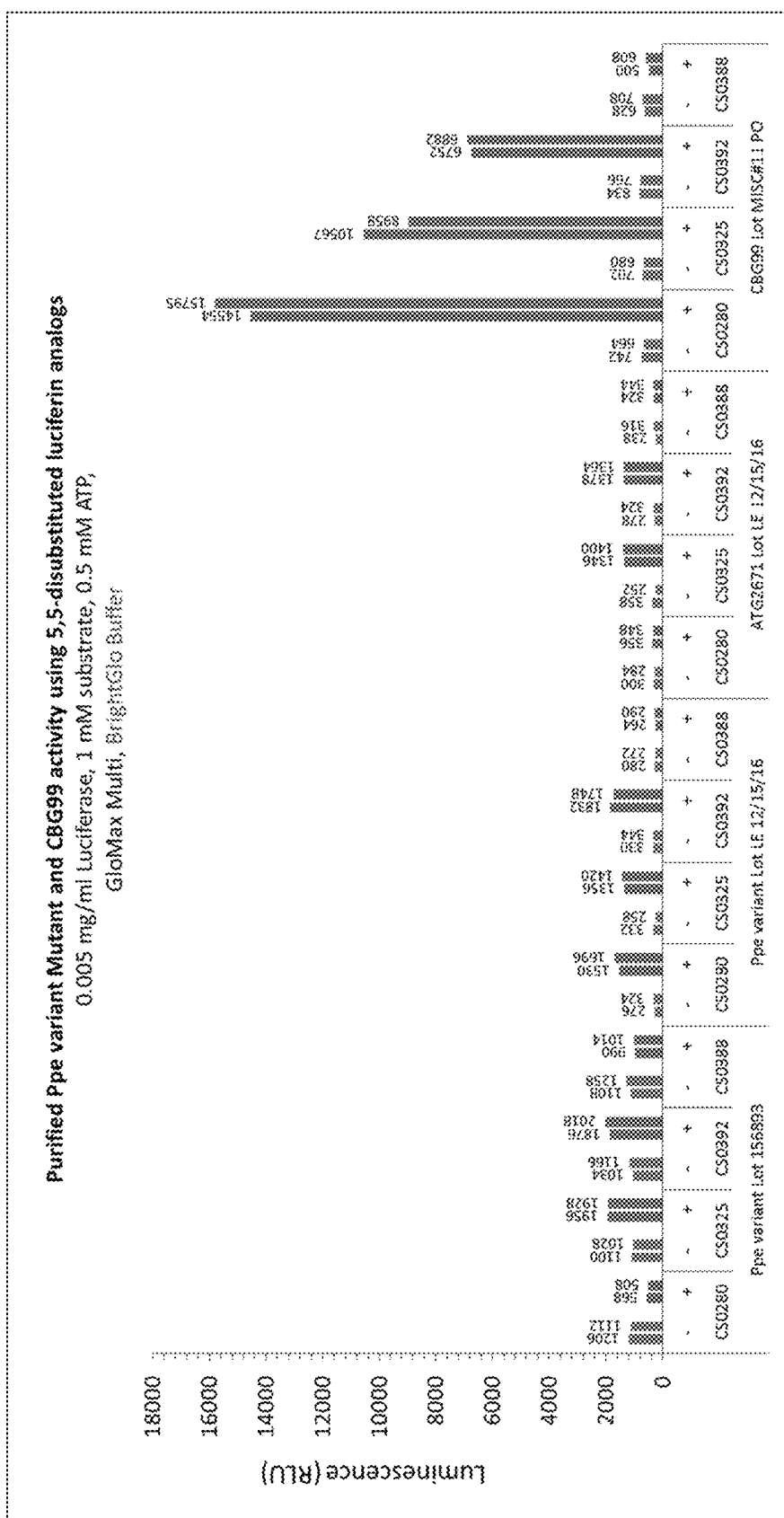
Figure 6C:
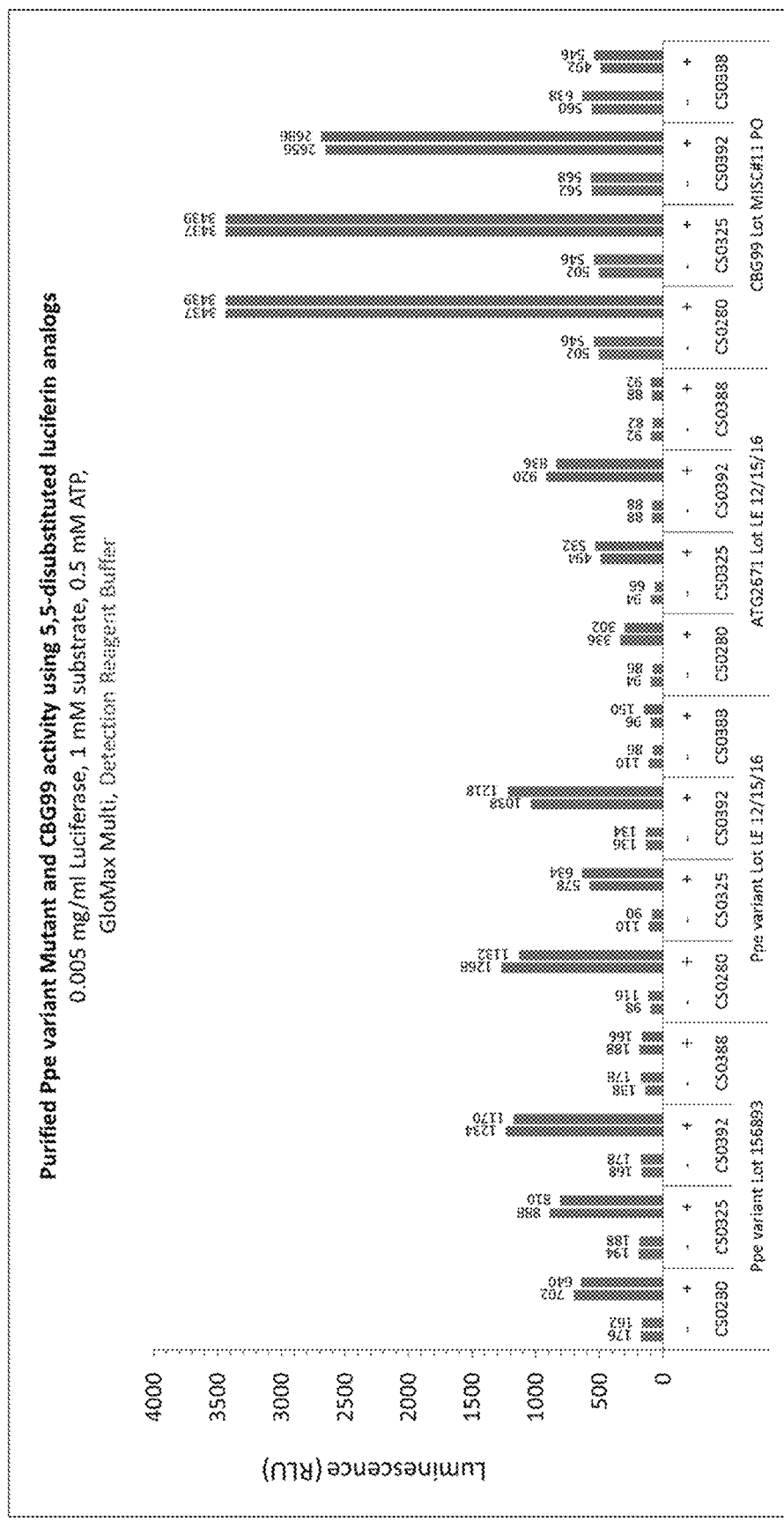

FIGS. 6A-6C include representative graphs comparing the activities of a thermostable variant of Ppe (SEQ ID NO: 1) and Click Beetle Green (CBG99) in the presence of 5,5-disubstituted luciferin analogs. Reagent compositions included either 0.005 mg/ml of the thermostable luciferase variant of Ppe (SEQ ID NO: 1) or CBG99 (click beetle green luciferase) enzymes diluted in 1×TBS+1% Prionex; ATP was diluted in buffer to 1 mM (Bright-Glo™ buffer for FIGS. 6A and 6B, and Detection Reagent Buffer for FIG. 6C); luciferase analog compounds were diluted in buffer+1 mM ATP; and 50 µl diluted enzyme combined with 50 µl diluted compound was diluted in buffer+ATP. Luminescence was read at 3 mins using GloMax® Multi luminometer. The high amount of luminescence observed in control samples without substrate ("no luciferin" controls) was likely due to contaminating luciferin in the reaction buffer, which needed to be used up ("burned off") during the reaction in order to reveal true substrate-specific signal. As shown in FIG. 6A, samples containing luciferin analogs that are below control levels indicate inhibition of the activity of both the Ppe variant and CBG99.

In FIGS. 6B-6C, the contaminating luciferin was burned off for 30 mins to baseline levels, and then substrate was added to measure specific luminescence activity. As demonstrated in FIG. 6B, very little signal was detected for the luciferin analogs in Bright-Glo™ buffer for the Ppe variant. However, significant luminescence was observed with CBG99 and the luciferin analogs. The use of Detection Reagent Buffer, as shown in FIG. 6C, in lieu of Bright-Glo™ buffer produced higher amounts of activity for the Ppe variant, but the trend is similar.

Combinations of Luciferase Enzyme Variants Having Increased Activity and Resistance to Dehydroluciferin FIG. 7 includes a representative graph assessing the activities of luciferase enzyme variants with amino acid substitutions at positions 244 and 339 of SEQ ID NO: 1 in the presence of 5,5-disubstituted luciferin analog substrate. Assays were prepared by combining overnight E. coli culture expressing enzymes with Detection Reagent+ATP+substrate (luciferin analog compounds CS0280, CS0333, CS0510, and CS0326), and luminescence was read at 3 mins. Reagent compositions included 50 µl lysate of the thermostable luciferase variant of Ppe variant of SEQ ID NO: 1, 0.5 mM substrate, and 1 mM ATP. These data indicate that experiments using E. coli lysates demonstrate that ATG-2889 (H244W) activity was approximately 285-fold above background with CS0333, and its activity was significantly higher than the activity of the thermostable luciferase variant of Ppe (SEQ ID NO: 1) with CS0333, which was below background (inhibited).

Figure 8:
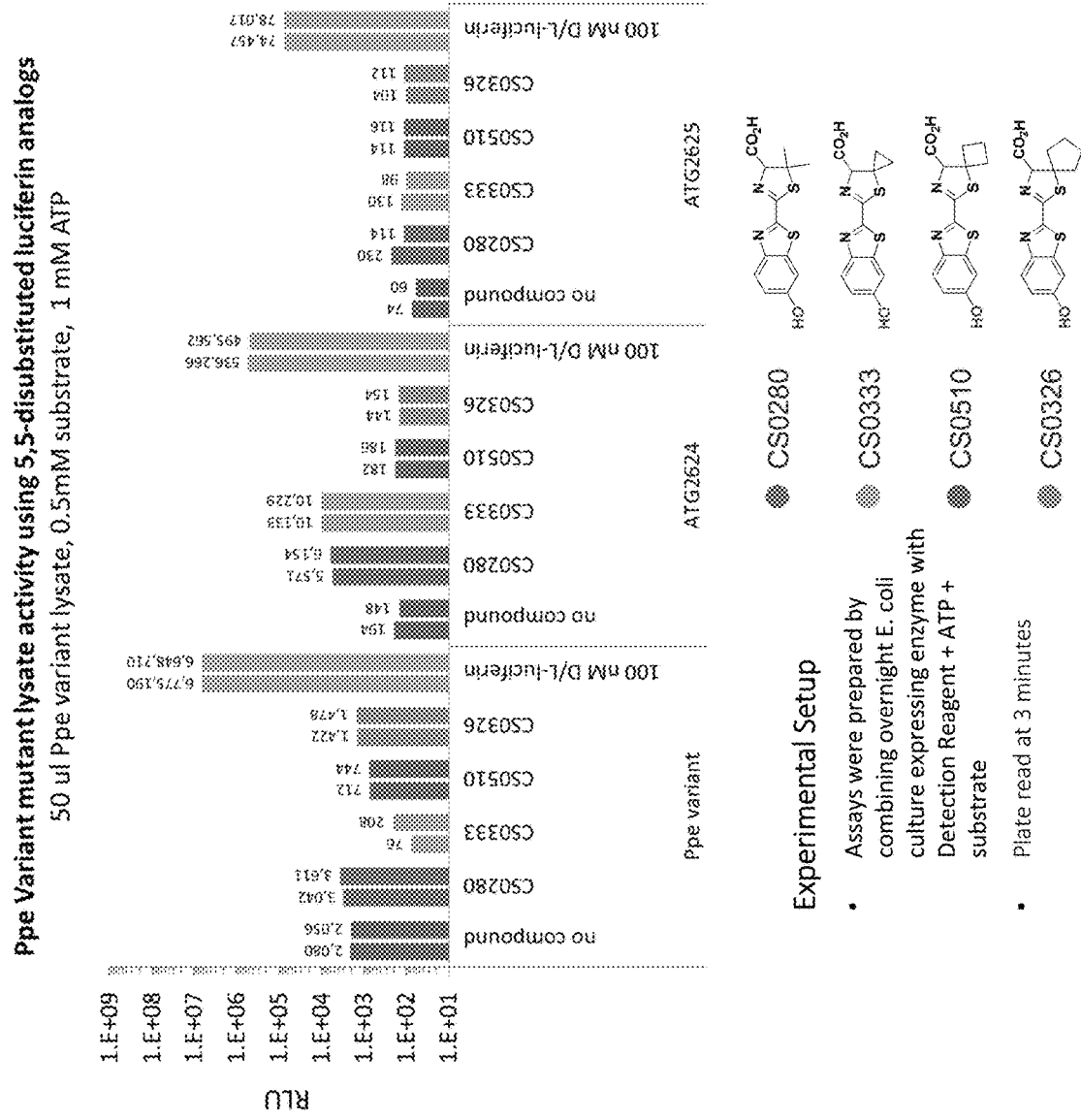
FIG. 8 includes a representative graph assessing the activities of luciferase enzyme variants ATG-2624 and ATG-2625 in the presence of 5,5-disubstituted luciferin analog substrate.

FIG. 8 includes a representative graph assessing the activities of luciferase enzyme variants ATG-2624 and ATG-2625 in the presence of 5,5-disubstituted luciferin analog substrate. Since mutations at position 244 (H244R) of the thermostable luciferase variant of Ppe (SEQ ID NO: 1) were not only resistant to dehydroluciferin, but also exhibited improved activity, variants with similar mutations were also tested. Specifically, ATG-2624 (I240L+Y254S+T344A+I396K) and ATG-2625 (H244R+V300G+I396K) were tested for activity on luciferin analogs in cell lysates. Assays were prepared by combining overnight E. coli culture expressing enzymes with Detection Reagent+ATP+substrate (luciferin analog compounds CS0280, CS0333, CS0510, and CS0326), and luminescence was read at 3 mins. Reagent compositions included 50 µl lysate of the thermostable luciferase variant of Ppe (SEQ ID NO: 1) luciferase lysate, 0.5 mM substrate, and 1 mM ATP. These data indicate that the ATG-2624 variant showed observable activity with the luciferin analog compounds indicating one or more of its mutations conferred activity.

Figure 9A:
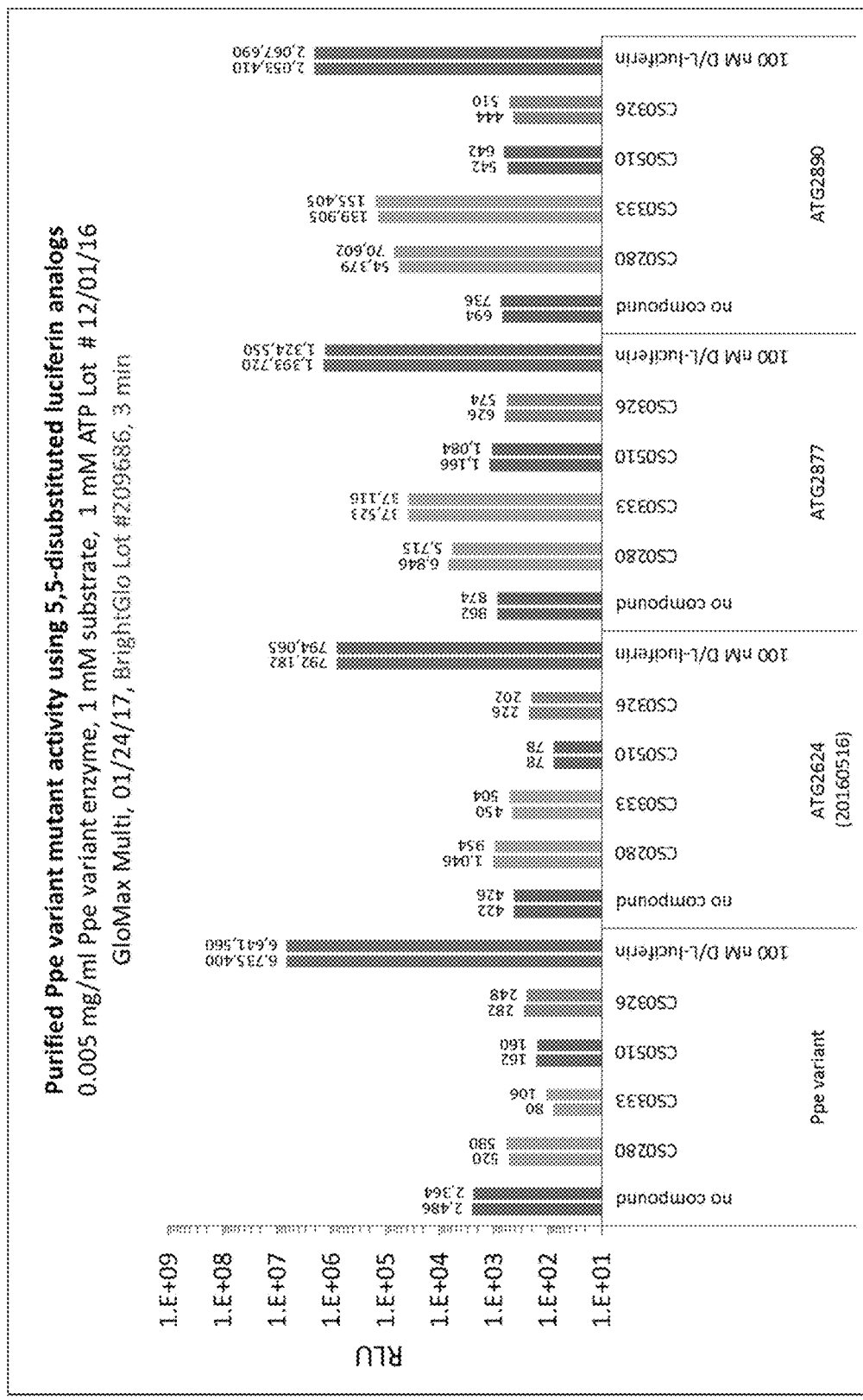

The H244W amino acid substitution in the thermostable luciferase variant of Ppe (SEQ ID NO: 1) that was identified during site-saturation screening was combined with the dehydroluciferin-resistant variant ATG-2624 to test its activity with 5,5-disubstituted luciferin analogs and to determine if these amino acid substitutions had an additive effect (ATG-2890). FIG. 9A includes a representative graph assessing the activities of luciferase enzyme variants ATG-2877, ATG-2624, and ATG-2890 in the presence of 5,5-disubstituted luciferin analog substrate. Luciferin analog compounds were diluted from 50 mM to 20 mM in reaction buffer (either Bright-Glo™ or Detection Reagent buffer). Luciferase enzymes were diluted in 1×TBS+1% Prionex to 0.01 mg/ml. Reagent compositions included 50 µl Reaction Buffer+ATP, which was combined with 50 µl diluted enzyme. Plates were incubated at room temp for 30 minutes to minimize background, and 5 µl of luciferin analog substrate was added to a final concentration of 1 mM. Plates were read before and after compound addition at 3 mins and 20 mins. The results of these experiments in purified enzyme format indicate that ATG-2890 exhibits additive improvement in light output with both CS0280 and CS0333 in both Bright-Glo™ and Detection Reagent buffers, and its activity was significantly higher than the activity of the thermostable luciferase variant of Ppe (SEQ ID NO: 1) with these analogs, which was below background (inhibited).

Figure 9B:
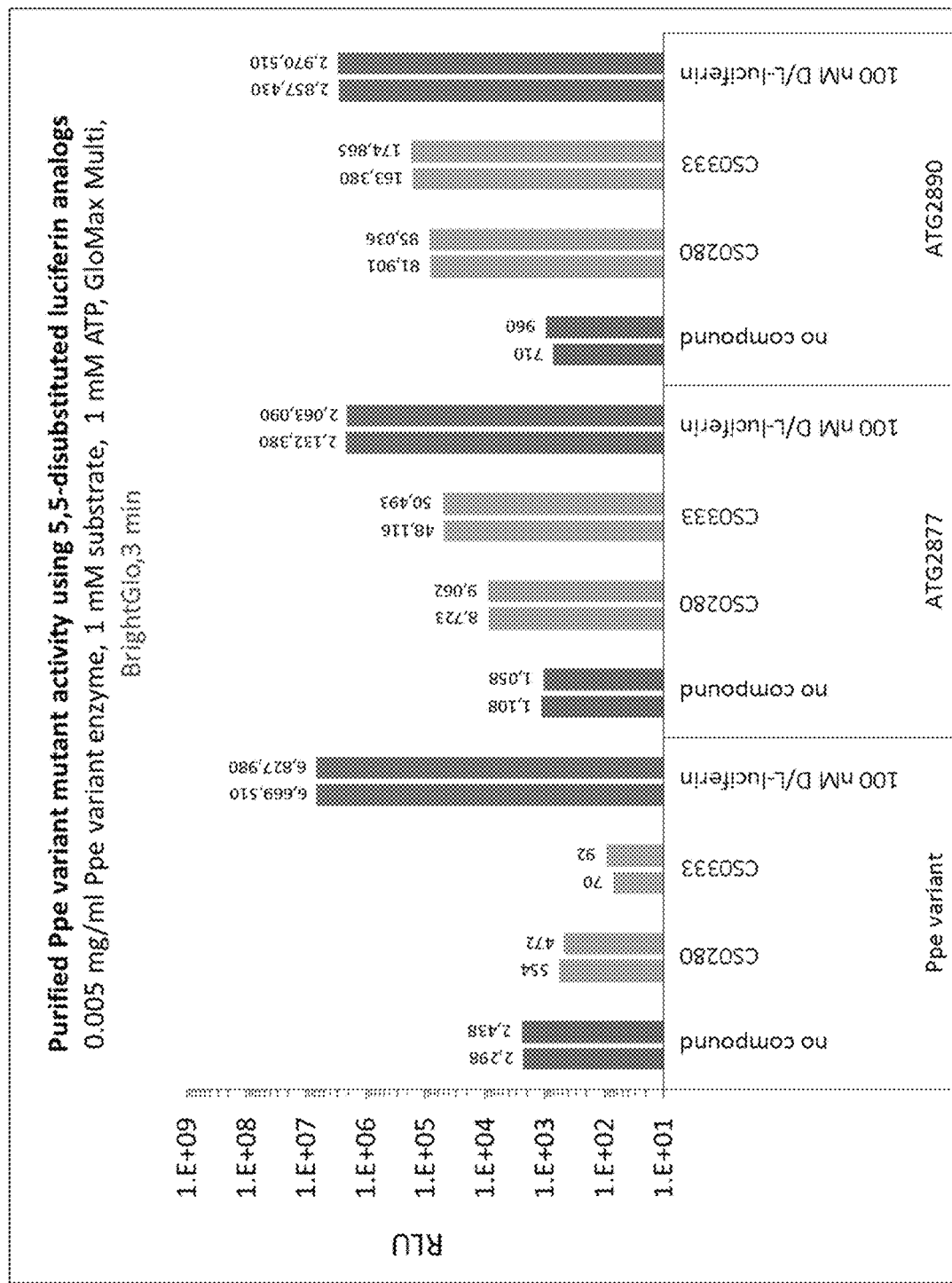

Using a similar setup as FIG. 9A, experiments were conducted to test the effects of both CS0280 and CS0333 luciferin analogs on the activity of luciferase enzyme variants ATG-2877 (H244W) and ATG-2890 (ATG-2624+H244W) (FIG. 9B). These results confirmed improved light output for ATG-2877 (H244W) and ATG-2890 (ATG-2624+H244W) variants with dimethyl and cyclopropyl luciferin analogs. Enzyme activities for both ATG-2877 and ATG-2890 were significantly higher than the activity of the thermostable luciferase variant of Ppe (SEQ ID NO: 1) with these analogs.

Figure 9D:
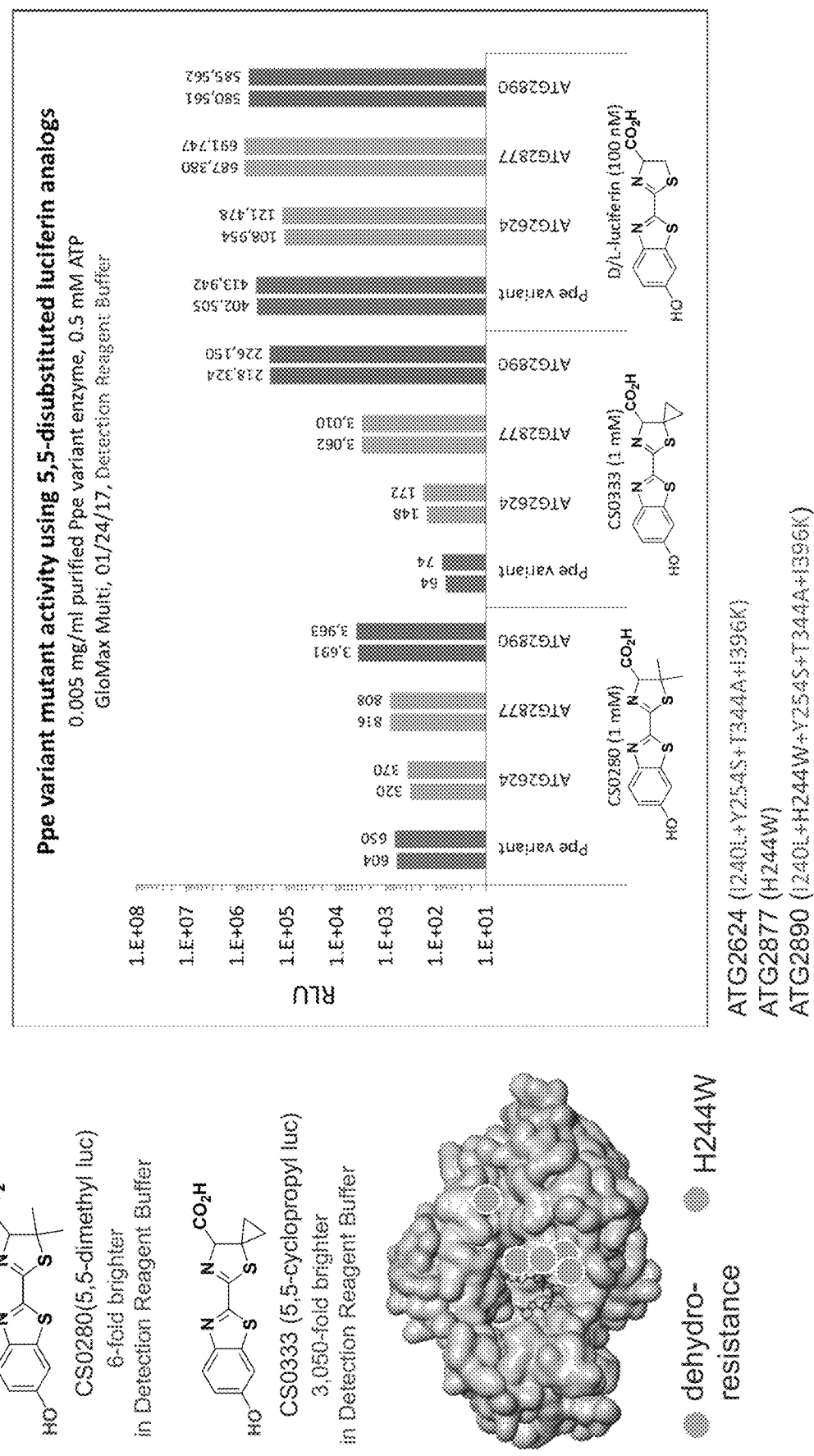

In FIGS. 9C and 9D, further experiments were conducted to confirm these results. As shown in FIG. 9C, the ATG-2890 variant exhibited a 120-fold increase in activity with CS0280 and a 1,470-fold increase in activity with CS0333 in Bright-Glo™ Buffer as compared to the thermostable luciferase variant of Ppe (SEQ ID NO: 1). Additionally, as shown in FIG. 9D, the ATG-2890 variant exhibited a 6-fold increase in activity with CS0280 and a 3,050-fold increase in activity with CS0333 in Detection Buffer as compared the thermostable luciferase variant of Ppe (SEQ ID NO: 1).

Figure 10A:
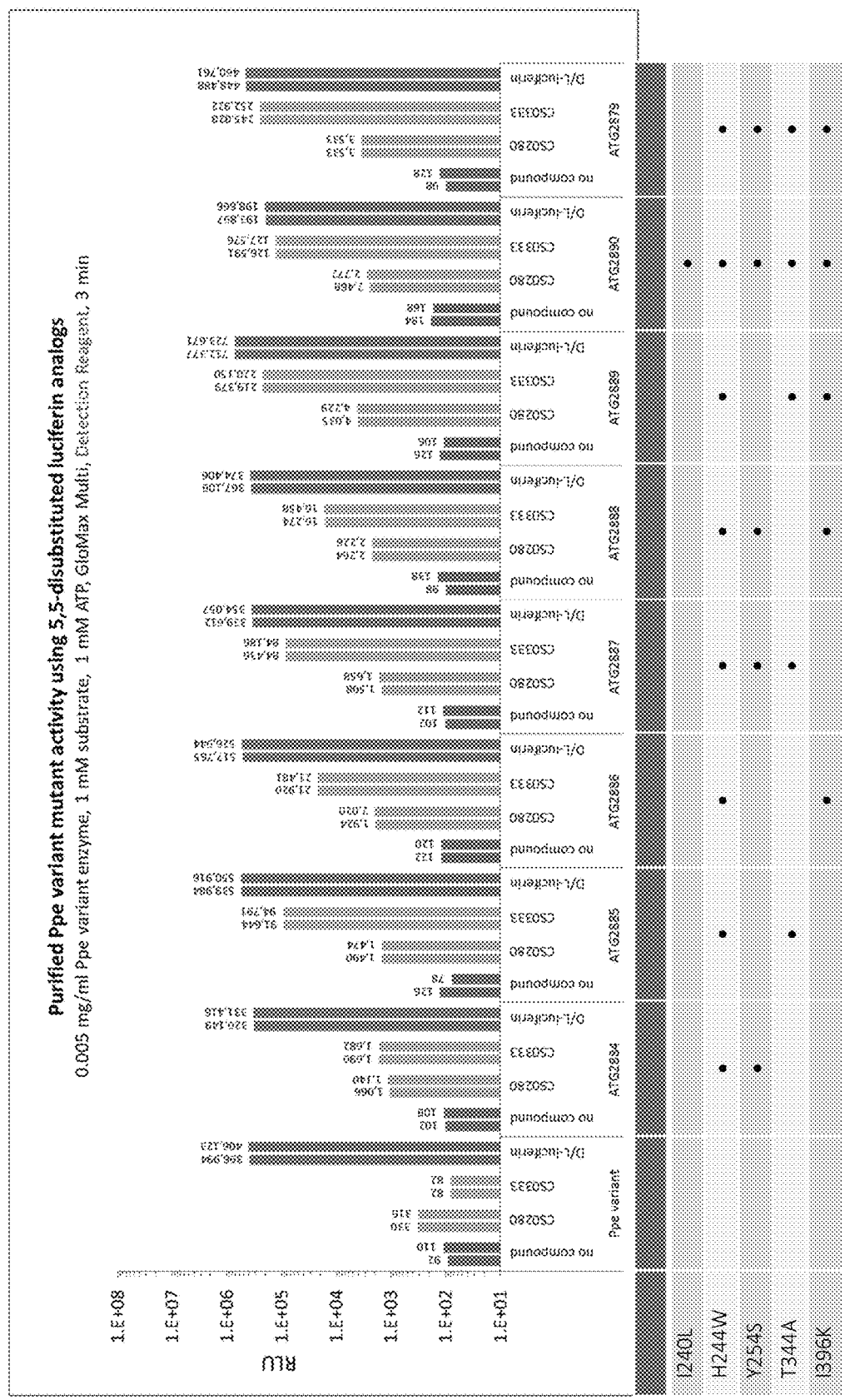
FIGS. 10A-10B include representative graphs assessing effects of amino acid substitutions on the activities of various luciferase enzyme variants in the presence of 5,5-disubstituted luciferin analog substrate.
Figure 10B:
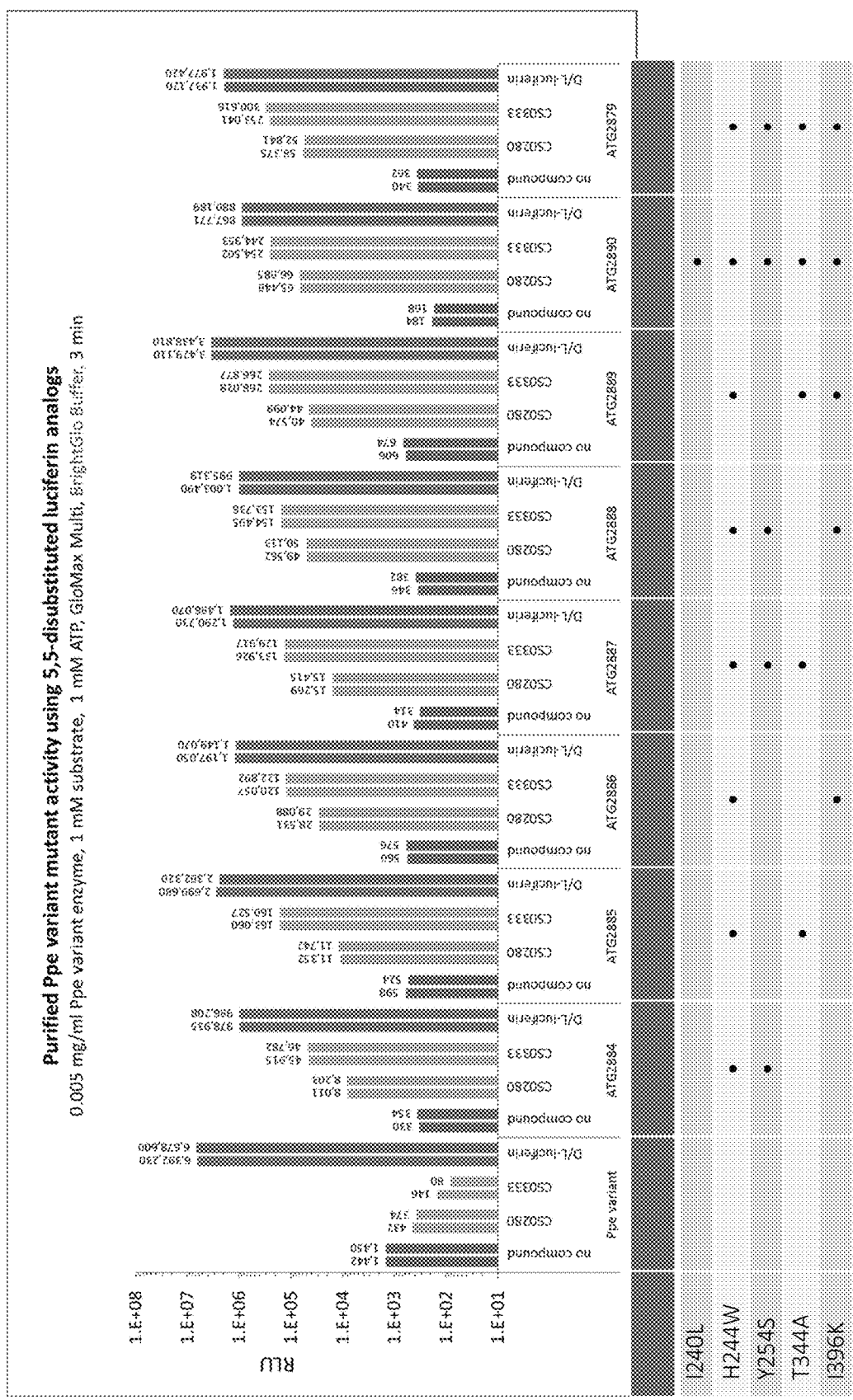

Determining Amino Acid Substitutions Important for Enhanced Luciferase Enzyme Activity FIGS. 10A-10B include representative graphs assessing effects of amino acid substitutions on the activities of various luciferase enzyme variants in the presence of 5,5-disubstituted luciferin analog substrate. Specifically, FIG. 10A includes the results of experiments using Detection Reagent buffer, and FIG. 10B includes the results of experiment using Bright-Glo™ buffer. Luciferin analog compounds were diluted from 50 mM to 20 mM in DMSO. Luciferase enzymes were diluted in 1×TBS+1% Prionex to 0.01 mg/ml. Reagent compositions included 50 µl of analog compound at 1 mM in either Bright-Glo™ or Detection Reagent buffer+1 mM ATP+0.5 mM compound, which was combined with 50 µl diluted enzyme in 1×TBS+1% Prionex. Plates were read at 3 mins. As shown in both FIGS. 10A and 10B, all combinations of amino acid substitutions tested resulted in luciferase enzyme variants having improved activity over the thermostable luciferase variant of Ppe (SEQ ID NO: 1) in utilizing either CS0280 (dimethyl luc) or CS0333 (cyclopropyl luc). The ATG-2889 variant was chosen for further evolution screening since it has the highest activity on both analogs in Detection Reagent Buffer.

Effects of Amino and Fluoro Versions of CS0333

Figure 11A:
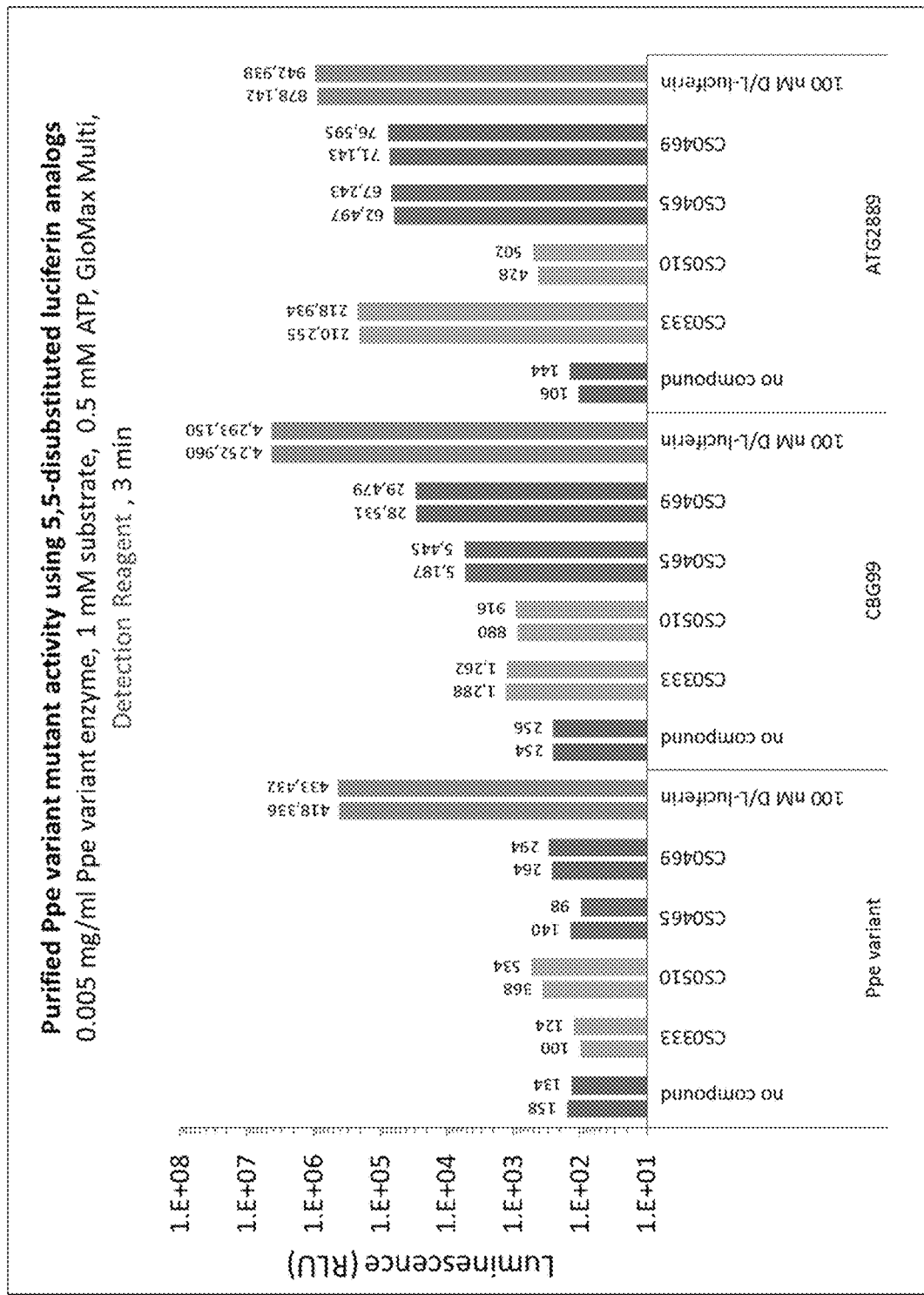
FIGS. 11A-11B include representative graphs assessing effects of amino and fluoro versions of the CS0333 luciferin analog used with luciferase enzyme variant ATG-2889 and Click Beetle Green (CBG99), and FIG. 11C includes a representative graph assessing the effects of different buffer compositions on ATG-2889 activity with CS0333.
Figure 11B:
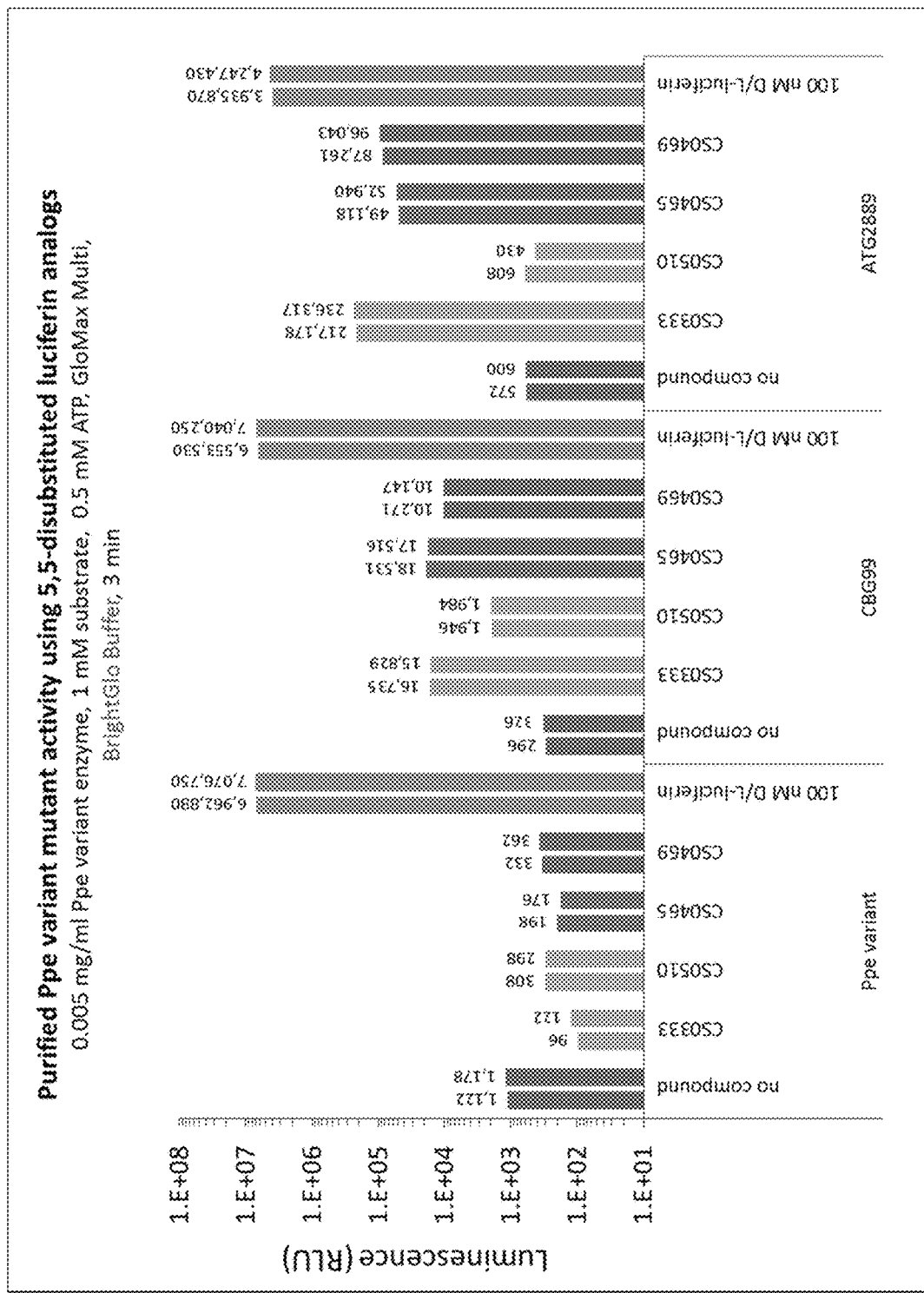

Activity of luciferase variant ATG-2889 (H244W+T344A+I396K) was compared with Click Beetle Green (CBG99), which was the only known luciferase that exhibited activity with the luciferin analogs. FIGS. 11A-11B include representative graphs assessing effects of amino (6916-01) and fluoro (9626-01) versions of the CS0333 luciferin analog used with luciferase enzyme variant ATG-2889 and Click Beetle Green (CBG99). Specifically, FIG. 11A includes the results of experiments using Detection Reagent buffer, and FIG. 11B includes the results of experiment using Bright-Glo™ buffer. Luciferin analog compounds were diluted from 50 mM to 20 mM in either Detection Reagent Buffer or Bright-Glo™ buffer. Luciferase enzymes were diluted in 1×TBS+1% Prionex to 0.01 mg/ml. Reagent compositions included 50 µl Reaction Buffer+ATP, which was combined with 50 µl diluted enzyme. Plates were incubated at room temp for 30 minutes to minimize background, and 5 µl of luciferin analog substrate was added to a final concentration of 1 mM (100 nM for OH-luciferin). Plates were read before and after compound addition at 3 mins and 20 mins. As shown in both FIGS. 11A and 11B, the ATG-2889 variant exhibits enhanced activity over CBG99 with luciferin analogs, and because ATG-2889 is a variant of the thermostable luciferase variant of Ppe of SEQ ID NO: 1, it also exhibits enhanced thermostability and tolerance to buffers as compared to CBG99. Additionally, amino (6916-01) and fluoro (9626-01) versions of CS0333 were less bright with ATG-2889 variant, even though they exhibited similar activity with CBG99.

Figure 11C:
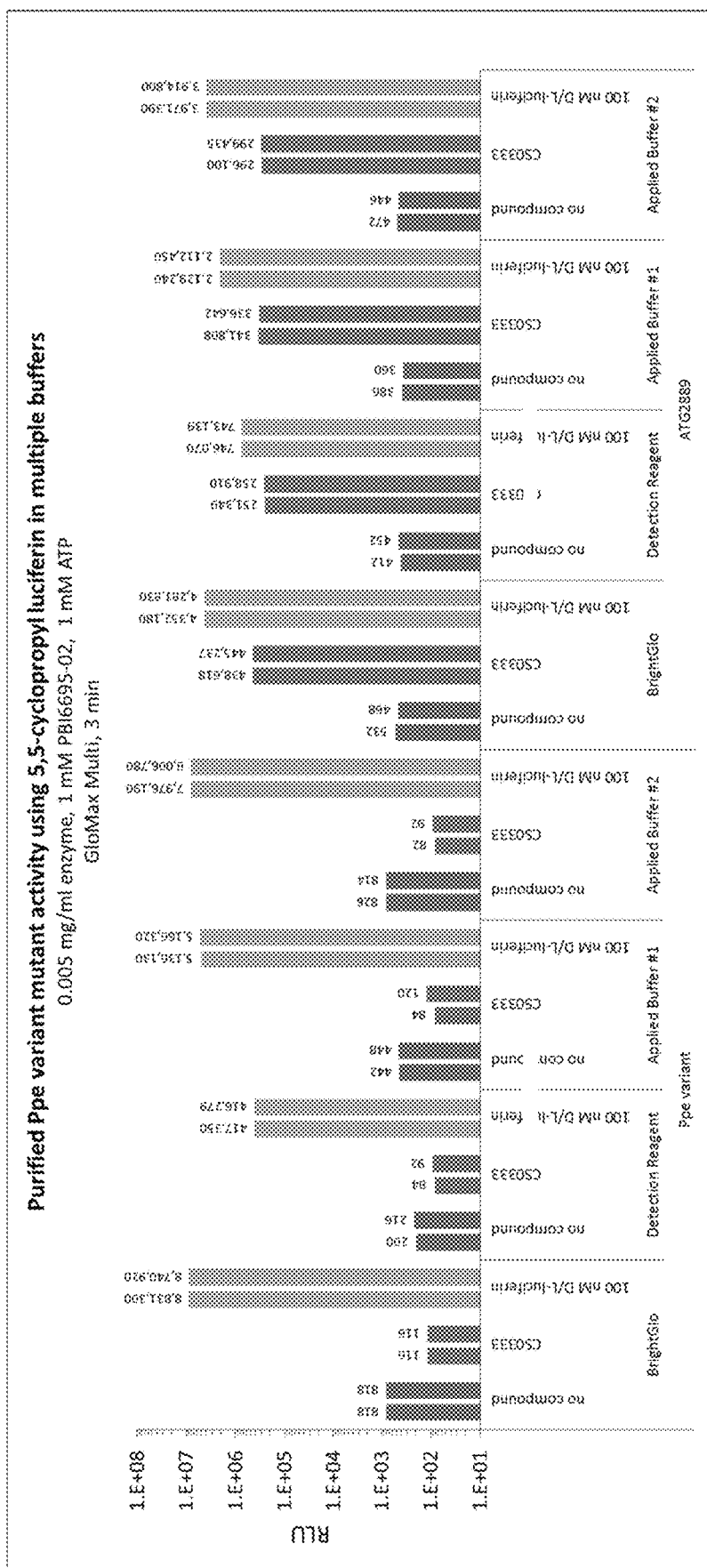

FIG. 11C includes a representative graph assessing the effects of different buffer compositions on ATG-2889 activity with CS0333. In addition to testing Bright-Glo™ buffer and Detection Reagent buffer, Applied Buffer #1 and Applied Buffer #2 were also tested. Applied Buffer #1 includes: 100 mM MES pH 6.5, 10 mM $MgCl_2$, 5 mM Sodium Citrate, 0.2% Tergitol, 10% Glycerol, and 0.2 mg/ml BSA. Applied Buffer #2 includes: 100 mM MES pH 6.5, 10 mM $MgCl_2$, 0.2% Tergitol, 0.4% Prionex, and 1 mM DTT. As shown, the activity of ATG-2889 was not significantly different among the buffers tested.

Evaluation of Luciferase Enzyme Variants Identified Using epPCR, DNA Shuffling, and Combinatorial Analysis Variants with amino acid substitutions conferring further improvements in enzyme activity were identified by Directed Evolution (DE) screening using an error-prone PCR (epPCR) library based on the thermostable luciferase variant of Ppe (SEQ ID NO: 1) followed by DNA shuffling of top hits to find optimal combinations of amino acid substitutions. FIG. 12A includes representative results of activity tests of these variants using CS0280, CS0333, and CS0510 luciferin analogs. To conduct these experiments, reagent compositions included 0.005 mg/ml enzyme+1 mM ATP+1 mM substrate in Bright-Glo™ (BG) or Detection Reagent (DR) buffers. As shown, several clones were identified by screening and confirmed with purified proteins to have improved brightness with CS0280 (dimethyl luc) and CS0333 (cyclopropyl luc). The table is colored according to their relative luminescence values within each column across a red to green color spectrum, with the lowest values colored red and the highest values colored green.

Following epPCR, DNA shuffling was used to identify the amino acid substitutions conferring improved activity of the luciferase enzyme variants identified. As shown in FIG. 12B, several additional amino acid substitutions were identified that conferred improved brightness with CS0333 in both Bright-Glo™ and Detection Reagent buffers over that of the ATG-2889 variant, including N228D, V300G, L305F, and S306P.

Figure 13:
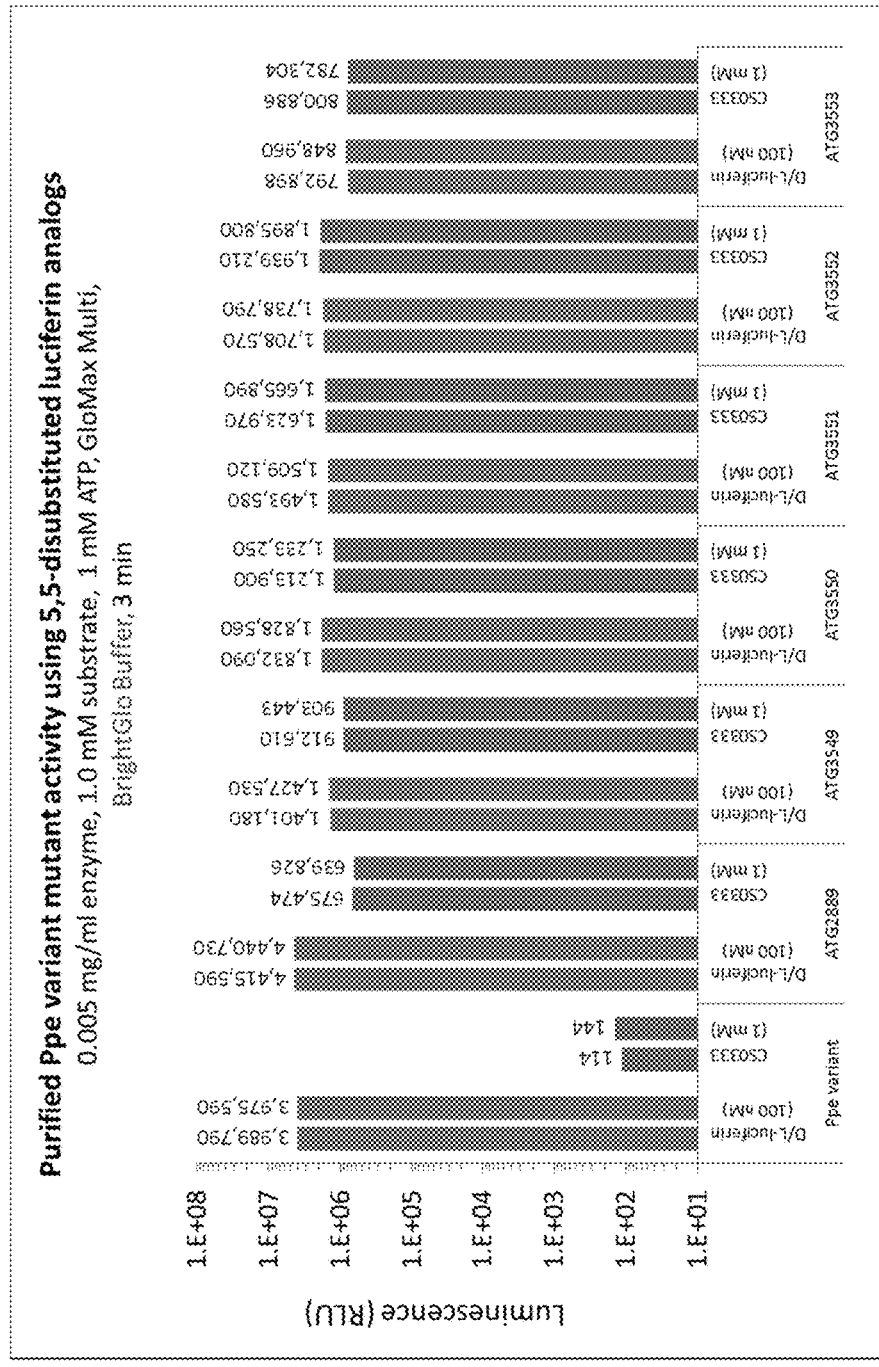
FIG. 13 includes a representative graph of the effects of amino acid substitutions V300G, L305F, and S306P on enzyme activity with the CS0333 analog.

FIG. 13 includes a representative graph of the effects of amino acid substitutions V300G, L305F, and S306P on enzyme activity with the CS0333 analog. Reagent compositions included 0.005 mg/ml enzyme+1 mM ATP+100 nM to 1 mM substrate in Bright-Glo™ buffer. As shown, all the variants tested, including ATG-2889, ATG-3549, ATG-3550, ATG-3551, ATG-3552, and ATG-3553, exhibited improved activity over the thermostable luciferase variant of Ppe (SEQ ID NO: 1) with CS0333 with ATG-3550 exhibiting the highest activity.

Figure 14:
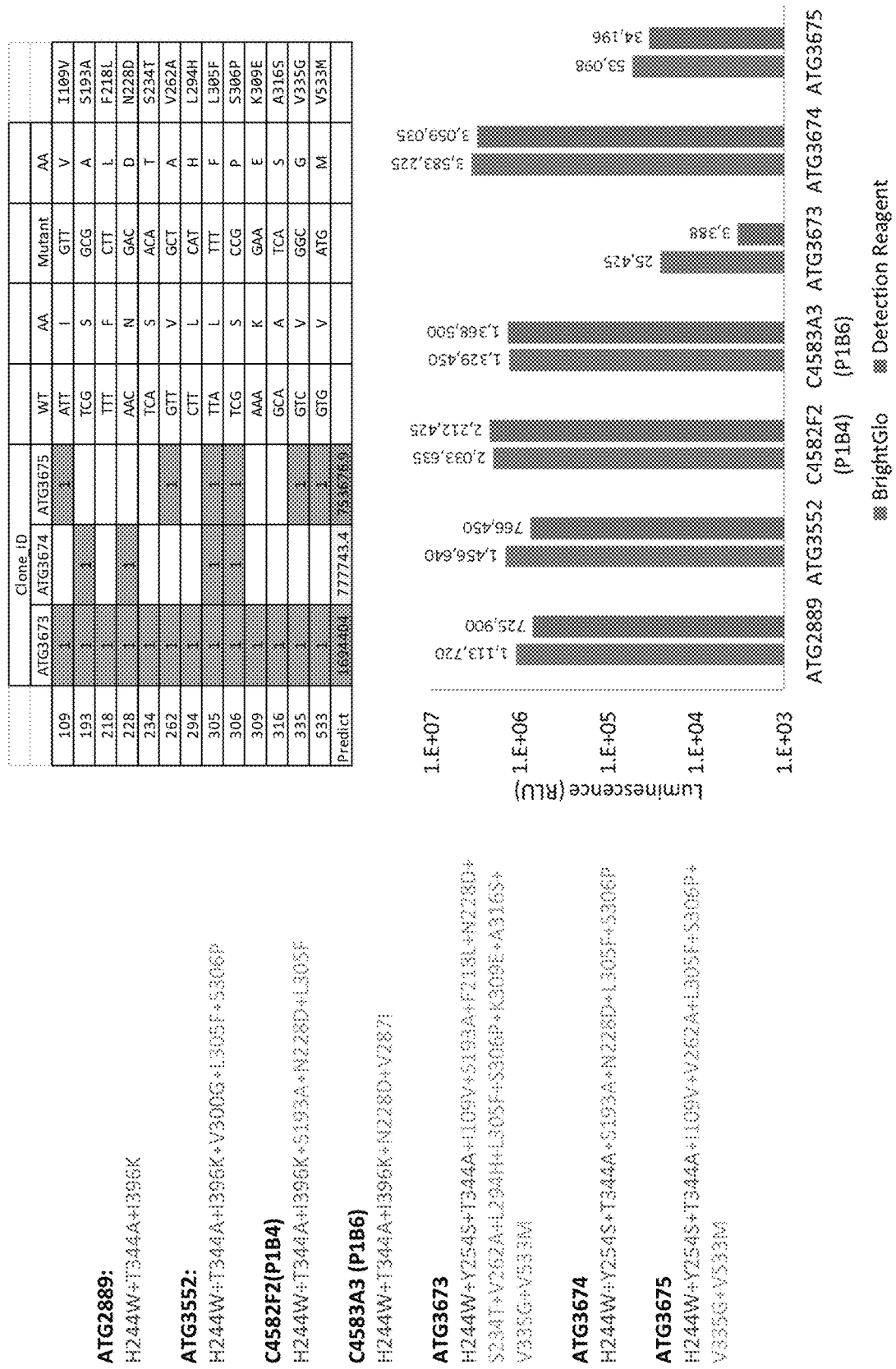
FIG. 14 includes representative results of activity tests of various luciferase enzyme variants with 5,5-disubstituted luciferin analogs identified using linear regression and combinatorial analysis.

Linear regression analysis of sequence data from DNA shuffling experiments described above predicted additional amino acid substitutions associated with improved enzyme activity with CS0333. FIG. 14 includes representative results of activity tests of various luciferase enzyme variants with 5,5-disubstituted luciferin analogs identified using linear regression and combinatorial analysis. Reagent compositions included 50 µl of 0.005 mg/ml enzyme+50 µl of 1 mM 5,5-cyclopropyl luciferin+1 mM ATP in Detection Reagent buffer. As shown, testing a small number of combinations led to the discovery that incorporating S193A+N228D+L305F into the ATG-2889 variant background further improved brightness with CS0333 in both Bright-Glo™ and Detection Reagent buffers.

Kinetic Tests of Luciferase Enzyme Variants

Figure 15:
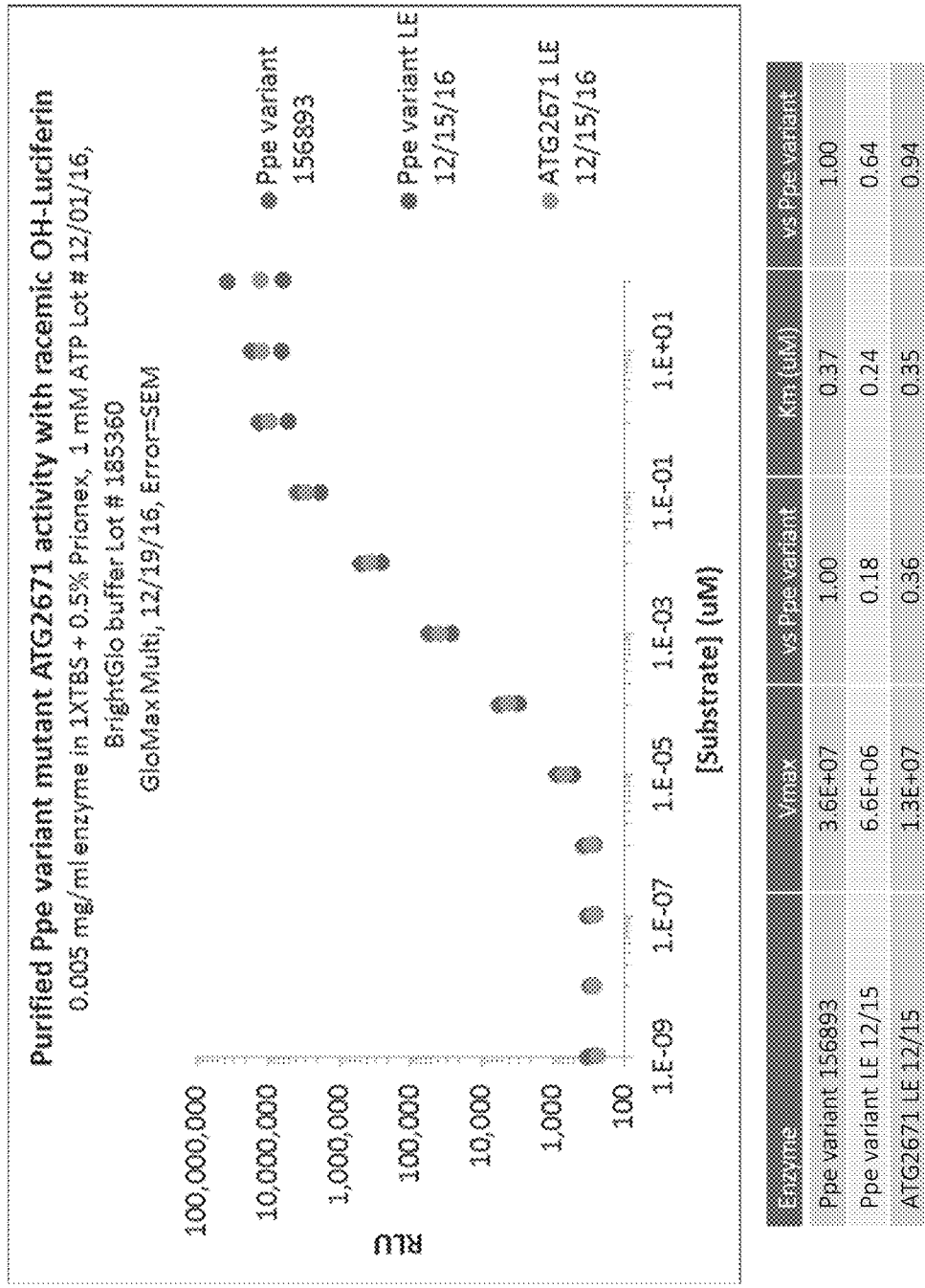
FIG. 15 includes representative graphs of kinetic activity of the luciferase enzyme variant ATG-2671 with D/L-luciferin.

Using rationale mutagenesis, amino acid substitutions were identified and hypothesized to confer improved activity in the luciferase enzyme variant ATG-2671 (G245A+L285I+G315A). To test this, the Vmax and Km for both the thermostable luciferase variant of Ppe (SEQ ID NO: 1) and ATG-2671 were compared. FIG. 15 includes representative graphs of kinetic activity of the luciferase enzyme variant ATG-2671 with D/L-luciferin. Reagent compositions included enzymes diluted in 1×TBS+1% Prionex to 0.01 mg/ml, ATP diluted to 2 mM in Bright-Glo™ buffer, OH-luciferin serially diluted in Bright-Glo™ buffer+ATP, 50 µl substrate in Bright-Glo™ buffer+ATP was combined with 50 µl diluted enzyme in 1×TBS+1% Prionex. The composition was incubated for 3 mins and read on GloMax® Multi+ platform. Although ATG-2671 was not active with luciferin analogs (data not shown), it did exhibit similar activity and kinetics as the thermostable luciferase variant of Ppe (SEQ ID NO: 1) with D/L-luciferin suggesting its inability to utilize luciferin analogs was not due to lack of enzyme activity.

Figure 16A:
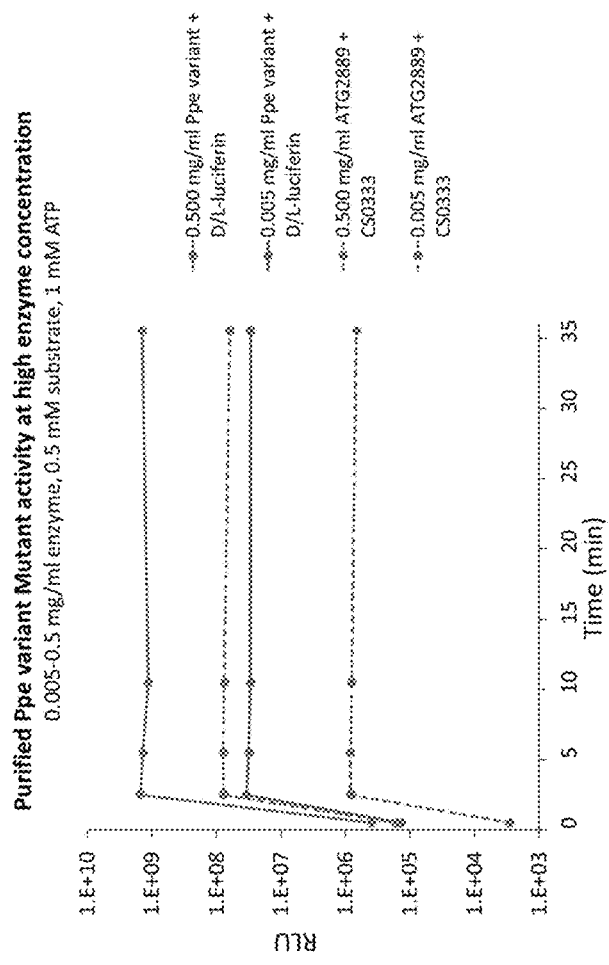

FIGS. 16A-16B include representative results of kinetic analysis of the thermostable luciferase variant of Ppe (SEQ ID NO: 1) with luciferin and the ATG-2289 variant with CS0333 in two buffer compositions. As shown in FIG. 16A, ATG-2889 exhibits nearly identical kinetics to the thermostable luciferase variant of Ppe (SEQ ID NO: 1) with D/L-luciferin in Detection Reagent buffer, but is slightly lower in brightness in Bright-Glo™ buffer. The Km for the substrate is improved in both buffers for ATG-2889 as compared to the thermostable luciferase variant of Ppe of SEQ ID NO: 1. ATG-2889 also exhibits significantly higher activity with CS0333 (cyclopropyl luc) as compared to the thermostable luciferase variant of Ppe (SEQ ID NO: 1). (CS0333 inhibits activity of the thermostable luciferase the Ppe variant.)

FIG. 16B provides similar results. Reagent compositions included enzymes diluted in 1×TBS+1% Prionex to 0.01 mg/ml, ATP diluted to 2 mM in Bright-Glo™ buffer, OH-luciferin serially diluted in Bright-Glo™ buffer+ATP, and 50 µl substrate (in Bright-Glo™ buffer+ATP) combined with 50 µl diluted enzyme in 1×TBS+1% Prionex. The composition was incubated for 3 mins prior to quantification. As shown, the activity of ATG-2889 was significantly higher with CS0333 (CS0333-02 and CS0333-02-Na) as compared to the Ppe variant thermostable luciferase (CS0333 inhibits the activity of the thermostable luciferase variant of Ppe of SEQ ID NO: 1). However, the Vmax of ATG-2889 with CS0333 (CS0333-02 and CS0333-02-Na) was 23.1-fold lower than the Vmax for luciferin in Bright-Glo™ buffer, and 42.9-fold lower than the Vmax for luciferin in Detection Reagent buffer.

FIG. 17 includes representative results of kinetic analysis of the thermostable luciferase variant of Ppe of SEQ ID NO: 1, ATG-2889, ATG-3552, and C4584D7 (P1B10) enzymes with luciferin and CS0333 in two buffer compositions (Bright-Glo™ buffer and Detection Reagent buffer). As shown, ATG-2889, ATG-3552, and C4584D7 (P1B10) variants exhibit kinetics that are similar to or improved over the thermostable luciferase variant of Ppe (SEQ ID NO: 1) with luciferin in either buffer.

Additionally, several other amino acid substitutions, including those not considered to be conservative or semi-conservative, were made to ATG-2889, as shown below in Table 2. These variants of ATG-2889 exhibited significantly higher activity with CS0333 as compared to the thermostable luciferase variant of Ppe (SEQ ID NO: 1) (far right column).

TABLE 2

Enhanced activity of thermostable ATG-2889 variants

| Enzyme | Position 344 | Position 396 | D/L-luciferin | CS0333 |
|---|---|---|---|---|
| Ppe variant | T | I | 7118320 | 178 |
| ATG2889 | A | K | 5507240 | 679219 |
| ATG2889-CL | C | L | 2022340 | 472771 |
| ATG2889-ML | M | L | 3320000 | 420902 |
| ATG2889-LM | L | M | 2364280 | 532567 |
| ATG2889-GV | G | V | 2540170 | 271903 |
| ATG2889-AL | A | L | 2861160 | 335698 |
| ATG2889-FR | F | R | 3651040 | 554573 |
| ATG2889-CR | C | R | 3078480 | 402799 |
| ATG2889-GL | G | L | 2372570 | 330032 |
| ATG2889-VV | V | V | 2902880 | 622854 |
| ATG2889-IT | I | T | 2614670 | 671610 |

Figure 18:
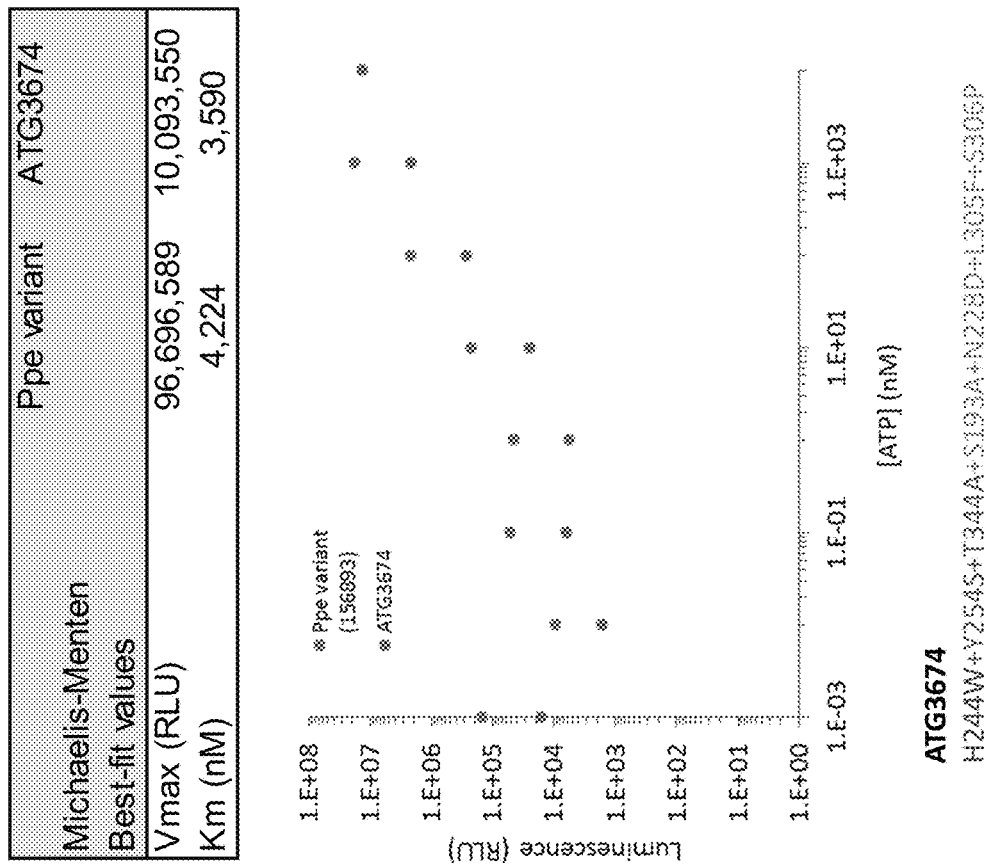
FIG. 18 includes representative results of kinetic analysis of a thermostable luciferase variant of Ppe (SEQ ID NO: 1) and ATG-3674 enzymes with luciferin and CS0333, respectively, in combination with ATP; the $K_m$ for ATP with saturating substrate was measured.

FIG. 18 includes representative results of kinetic analysis of the thermostable luciferase variant of Ppe (SEQ ID NO: 1) and ATG-3674 enzymes with luciferin and CS0333, respectively, in combination with ATP. Reagent composition included 1 mM substrate, 100 fM-100 uM ATP (10-fold dilutions), and 0.1 mg/ml enzyme. As shown, ATG-3674 with CS0333 combination showed equivalent to improved Km values for ATP relative to the thermostable luciferase variant of Ppe (SEQ ID NO: 1) with luciferin combination indicating that the amino acid substitutions in ATG-3674 do not affect the sensitivity of ATP detection. Thus, the combination of the ATG-3674 luciferase enzyme variant with the thermostable CS0333 luciferin analog substrate will be effective in ATP detection/quantification assays.

Further analysis of luciferase enzyme variants with various amino acid substitutions led to the identification of the ATG-3707 variant (H244W+Y254S+T344A+S193A+N228D+L305F+S306P+I109V). FIGS. 19A-19D include representative results of activity data and kinetic analysis of various luciferase enzyme variants identified using epPCR with FIGS. 19B-19C highlighting the enhanced activity of variant ATG-FIG. 19A includes representative results of kinetic analysis of various luciferase enzyme variants identified using epPCR, using a 5,5-cyclopropyl luciferin. Reagent composition included 0.005 mg/ml enzyme in 1×TBS+0.5% Prionex, 1 mM ATP, and 10 fM-1 mM substrate (serial dilutions in Detection Reagent buffer). As shown, additional amino acid substitution combinations from variants identified during epPCR revealed that I109V also improved enzyme activity further, resulting in ATG-3707 (H244W+Y254S+T344A+S193A+N228D+L305F+S306P+I109V). Additionally, amino acid substitutions at positions 109, 214, 335 all increased Vmax.

Figure 19B:
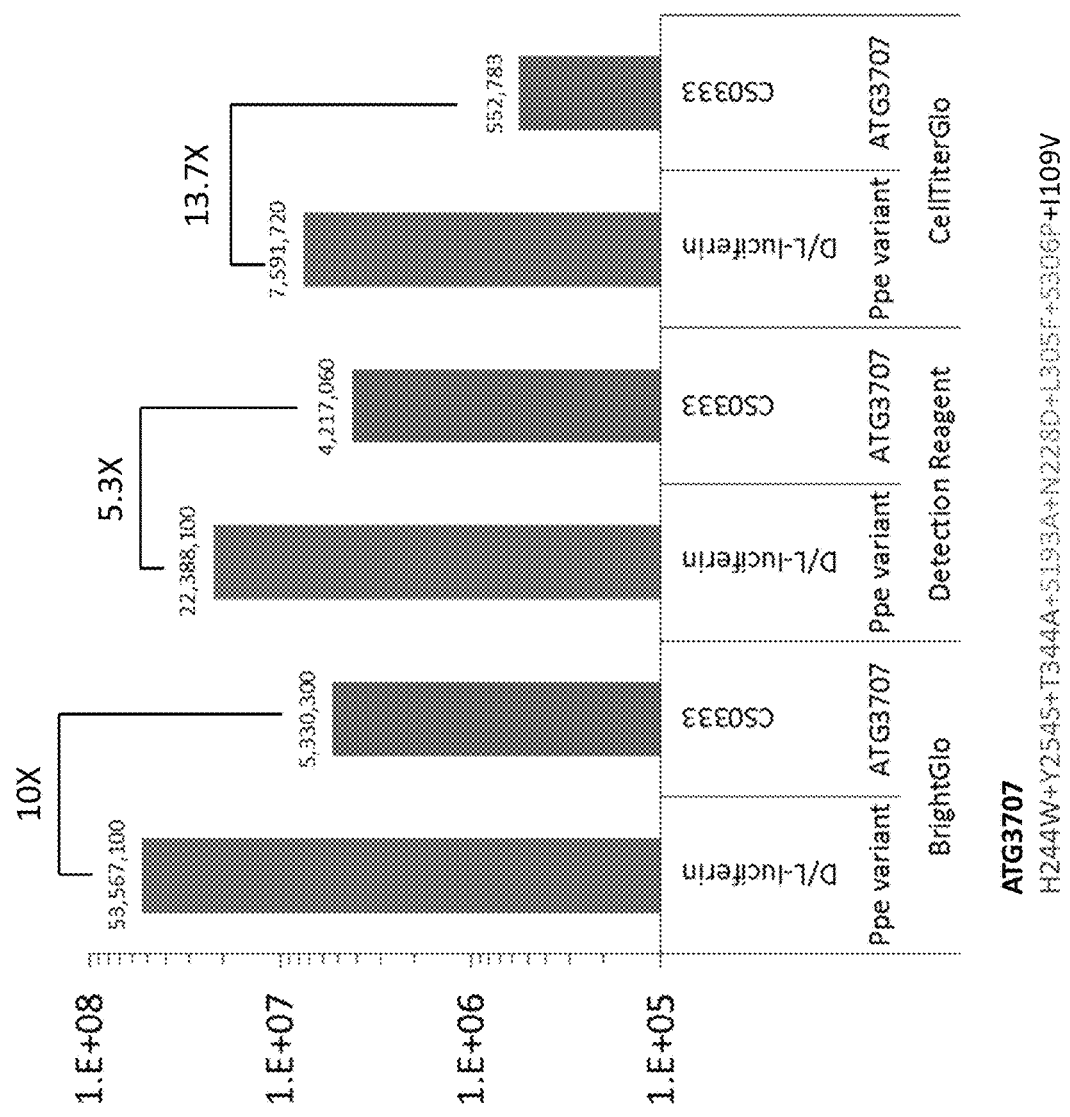
Figure 19C:
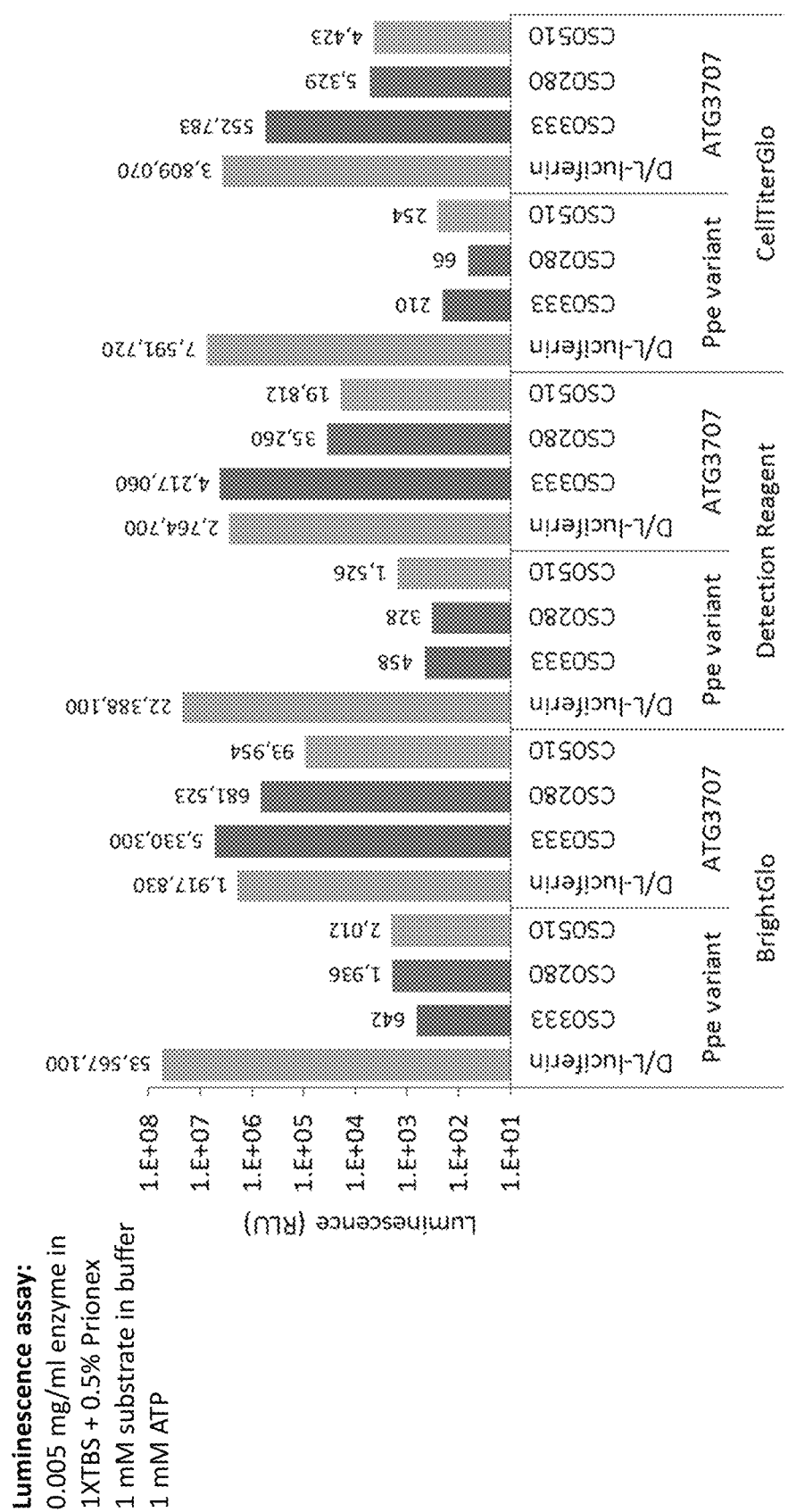

FIGS. 19B-19C include representative results of activity tests comparing the thermostable luciferase variant of Ppe (SEQ ID NO: 1) with luciferin and the ATG-3707 variant with CS0333 in three buffer compositions. Reagent compositions included 0.005 mg/ml enzyme in 1×TBS+0.5% Prionex, 1 mM substrate in buffer, and 1 mM ATP. In FIG. 19B, the ATG-3707 variant exhibited the highest activity among the variants, and as shown, its activity with CS0333 was comparable (e.g., within 10×) to that of the thermostable luciferase variant of Ppe (SEQ ID NO: 1) with luciferin in both Bright-Glo™ and Detection Reagent buffers. In FIG. 19C, the ATG-3707 variant exhibited the highest activity with CS0333 followed by CS0280 and CS0510, and exhibited higher activity with CS0333 than with D/L-luciferin. This demonstrates that the amino acid substitutions in the ATG-3707 variant confer the ability to utilize CS0333 and other luciferin analogs with high efficiency instead of luciferin. FIG. 19D includes representative kinetic data demonstrating some loss of performance of ATG-3707 with D/L-luciferin as compared to CS0333 (about 1 log dimmer), a red-shifted wavelength peak of light output at 600 nm, and the highest Vmax of the purified variants tested.

Figure 19E:
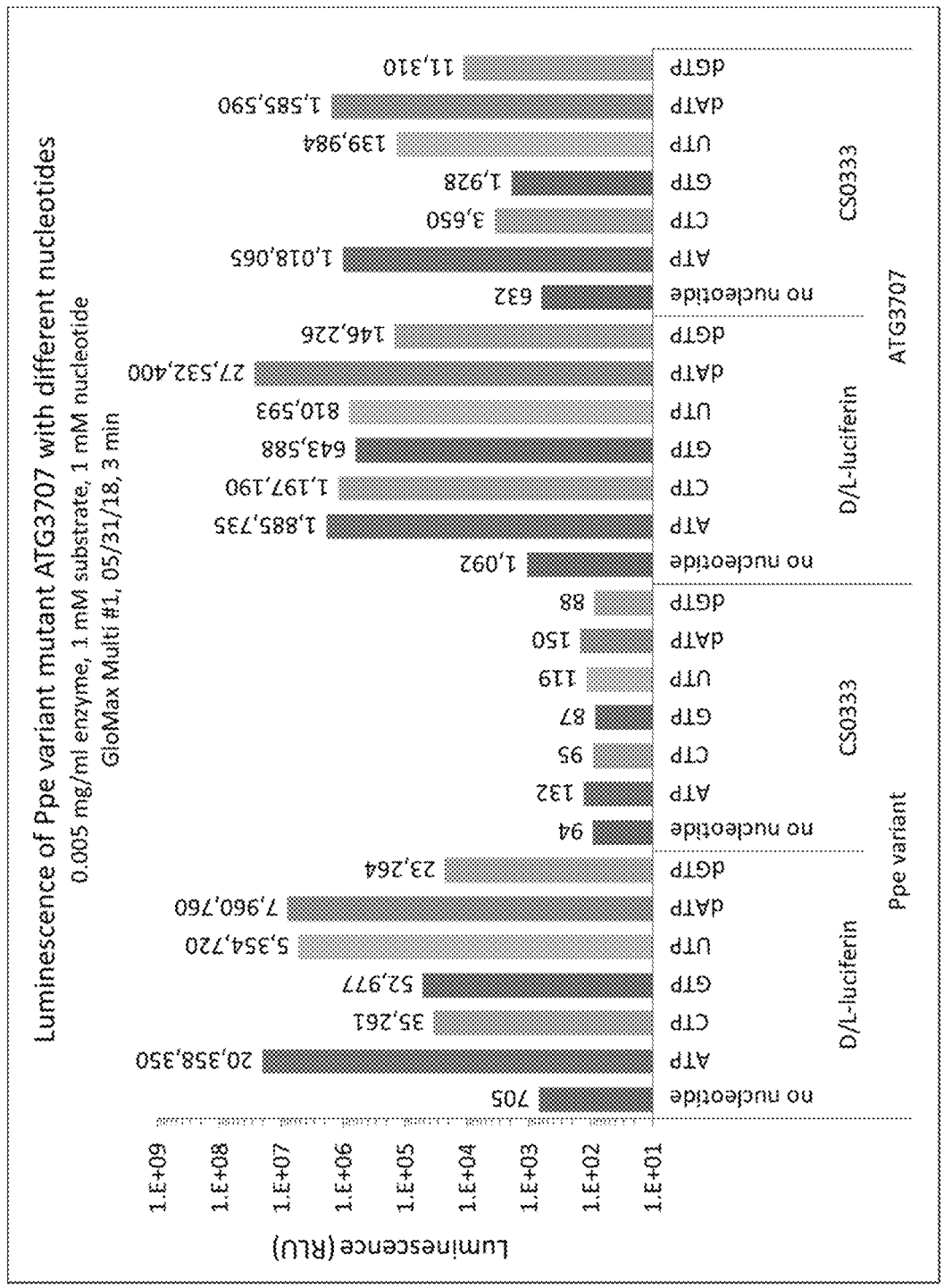
Figure 20A:
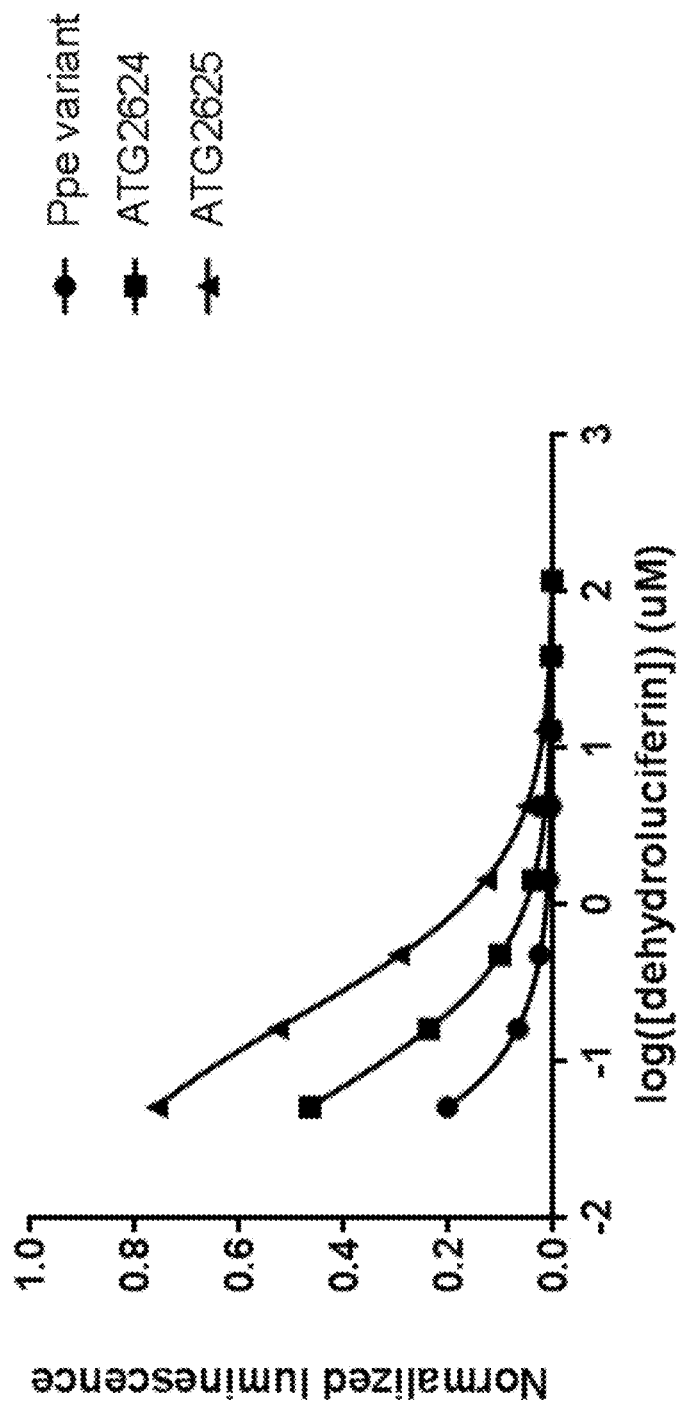
Figure 20B:
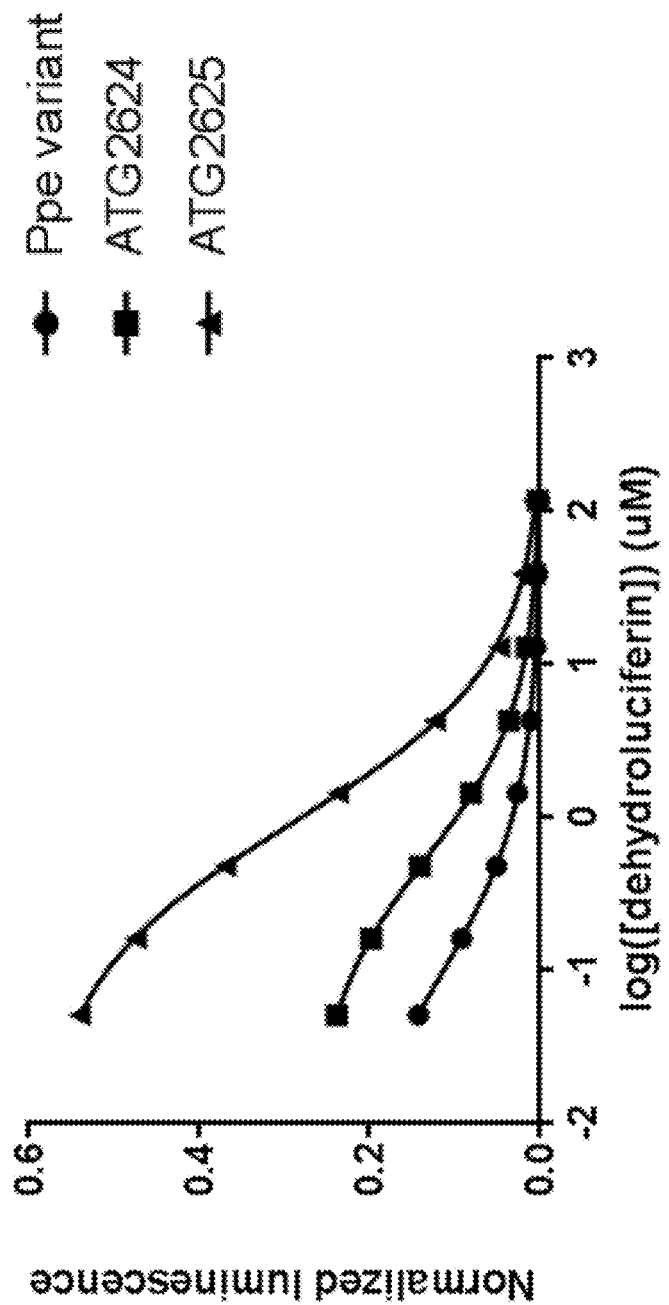
Figure 21A:
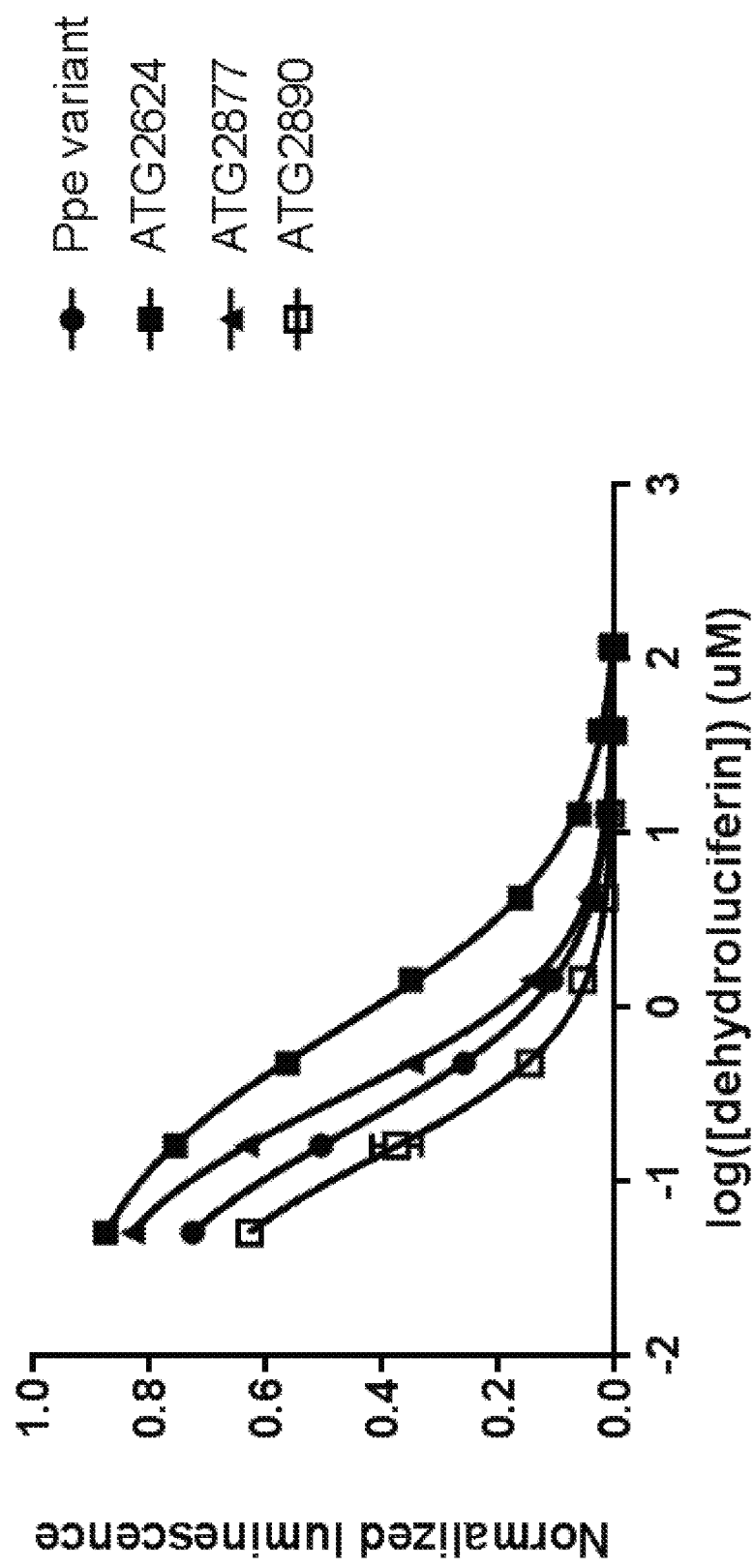
FIGS. 21A-21B include graphs of luminescence of various luciferase enzyme variants in the presence of increasing dehydroluciferin concentration and (FIG. 21A) Detection reagent buffer or (FIG. 21B) Bright-Glo™ buffer, and a table depicting IC50 values (µM) derived therefrom (FIG. 21C).
Figure 21B:
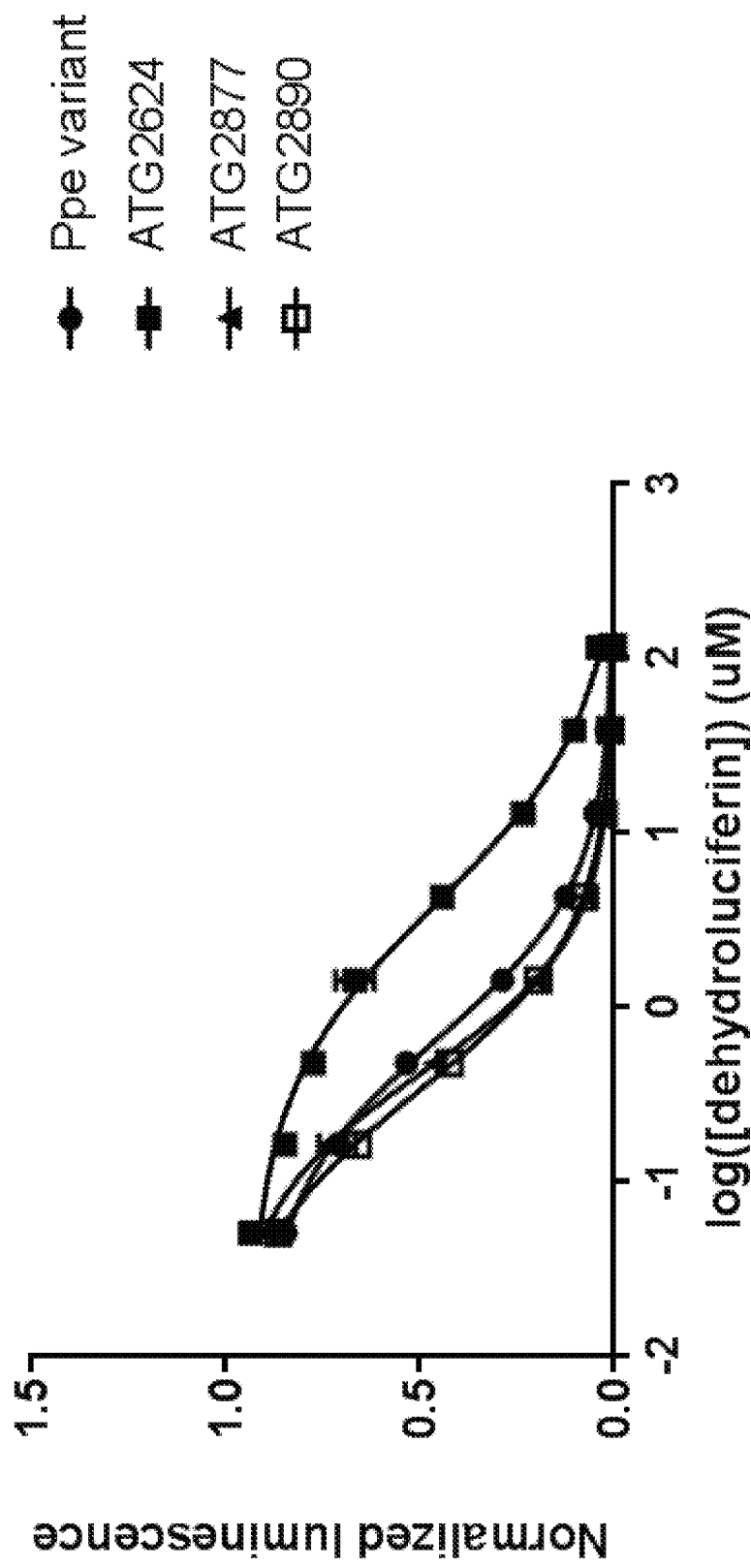

FIG. 19E includes representative results of activity tests comparing the thermostable luciferase variant of Ppe (SEQ ID NO: 1) and the ATG-3707 variant with either luciferin or CS0333, as well as various nucleotides (ATP, CTP, GTP, UTP, dATP, and dGTP). Reagent compositions included enzyme diluted to 0.01 mg/ml in 1×TBS+0.5% Prionex. Substrate was diluted to 2 mM in Bright-Glo™ buffer, and individual nucleotides were diluted in water to 22 mM. Approximately 50 µl of diluted enzyme was combined with 50 µl of diluted substrate. The reactions were incubated at room temperature for about 90 mins. Approximately 11 µl of nucleotide was spiked into the indicated reactions and luminescence was read after 3 mins. These data demonstrate that the luciferase variant ATG-3707 can utilize all nucleotides for catalysis (similar to the Ppe variant). However, unlike the Ppe variant, ATG-3707 can also utilize all nucleotides for catalysis when CS0333 is present as the substrate.

A summary of Vmax and Km of the thermostable luciferase variant of Ppe (SEQ ID NO: 1) and ATG-3707 (SEQ ID NO: 2) with different substrates is provided in Table 3 (below). The ATG-3707 variant exhibits a lower Km for racemic luciferin than the thermostable luciferase variant of Ppe (SEQ ID NO: 1) in Bright-Glo™ and CellTiterGlo® buffers.

TABLE 3

Vmax and Km values for the thermostable luciferase variant of Ppe of SEQ ID NO: 1 and ATG-3707

| | Buffer | | | | | | |
|---|---|---|---|---|---|---|---|
| | BrightGlo | | | Detection Reagent | | | CellTiterGlo |
| | Substrate | | | | | | |
| | D/L-luciferin | | CS0333 | D/L-luciferin | | CS0333 | D/L-luciferin |
| | Enzyme | | | | | | |
| | Ppe variant | ATG3707 | ATG3707 | Ppe variant | ATG3707 | AT63707 | Ppe variant | ATG3707 |
| Vmax (RLU) | 23,319,814 | 2,033,235 | 3,724,104 | 10,017,520 | 4,499,483 | 5,458,906 | 5,771,822 | 4,840,502 |
| Km (uM) | 0.315 | 0.030 | 0.539 | 10.780 | 19.360 | 4.818 | 1059.000 | 91.680 |

A second round of epPCR was performed to identify amino acid substitutions conferring improved activity of the luciferase enzyme variant ATG-3707. As shown in Table 4 below, several additional amino acid substitutions were identified that conferred improved brightness with CS0333 in Bright-Glo™, CellTiterGlo®, and Detection Reagent buffers (see also FIG. 2C). Reagent compositions included CS0333 diluted from 20 mM to 2 mM in reaction buffer with 2 mM ATP. Purified enzymes were diluted in 1×TBS+1% Prionex to 0.01 mg/ml, and 50 µl of diluted enzyme was combined with 50 µl diluted CS0333+ATP mixed in each well in reaction buffer. Reactions were incubated at 25° C. for 3 min, and luminescence was read and then normalized to ATG-3707 activity tested in parallel. As shown, all luciferase enzyme variants identified exhibited at least a 10% improvement over ATG-3707 in one or more of the buffers tested.

identify amino acid substitutions conferring improved activity on the CS0280 (dimethyl luciferin) and CS0333 (cyclopropyl luciferin) analogs (Table 6). These experiments included lysing E. coli cells expressing each luciferase enzyme variant in Detection Reagent containing 1 mM ATP+500 µM substrate. The cell lysate was incubated at room temperature for 3 mins and luminescence was read. The raw luminescence reading was normalized to the on-plate luminescence of ATG-2889, which was used as a control in this screen. (Normalized luminescence=(Mutant RLU/ATG2889 RLU).) As shown below in Table 6, all luciferase enzyme variants exhibited at least 3.5-fold or

TABLE 4

Variants of ATG-3707 with improved activity

| | | Luminescence (RLU) | | | Normalized Luminescence | | |
|---|---|---|---|---|---|---|---|
| Well | Enzyme | Detection Reagent | BrightGlo | CellTiterGlo | Detection Reagent | BrightGlo | CellTiterGlo |
| G12 | ATG3707 | 5157310 | 3887670 | 644571 | 1.00 | 1.00 | 1.00 |
| E2 | C2240E2 | 6978270 | 3202900 | 976519 | 1.35 | 0.82 | 1.51 |
| F10 | C2261D9 | 6890380 | 4380280 | 628712 | 1.34 | 1.13 | 0.98 |
| E6 | C2242E1 | 6604720 | 5643850 | 708509 | 1.28 | 1.45 | 1.10 |
| F7 | C2260B6 | 6230440 | 2896240 | 921045 | 1.21 | 0.74 | 1.43 |
| B6 | C2158H1 | 6098750 | 3760160 | 778990 | 1.18 | 0.97 | 1.21 |
| B5 | C2158A3 | 6034440 | 3392960 | 1027180 | 1.17 | 0.87 | 1.59 |
| B7 | C2158H3 | 5916440 | 3892740 | 648483 | 1.15 | 1.00 | 1.01 |
| G2 | C2262C2 | 5661740 | 3874490 | 738328 | 1.10 | 1.00 | 1.15 |
| B10 | C2159F8 | 5611680 | 4599710 | 650068 | 1.09 | 1.18 | 1.01 |
| A6 | C2149A12 | 5480500 | 4701610 | 479613 | 1.06 | 1.21 | 0.74 |
| F12 | C2261E4 | 5375380 | 3249560 | 710098 | 1.04 | 0.84 | 1.10 |
| B12 | C2160C1 | 5002710 | 4459170 | 450262 | 0.97 | 1.15 | 0.70 |
| F9 | C2261D1 | 4820920 | 3436380 | 841889 | 0.93 | 0.88 | 1.31 |

Additionally, Table 5 (below) includes kinetic analysis of the ATG-3707 variants identified above. Reagent compositions included CS0333 serially diluted 10-fold from 1 mM to 10 fM in reaction buffer with 2 mM ATP. Purified enzymes were diluted in 1×TBS+1% Prionex to 0.01 mg/ml, and 50 µl of diluted enzyme was combined with 50 µl diluted CS0333+ATP mixed in each well in reaction buffer. Reactions were incubated at 25° C. for 3 min, and luminescence was read and then normalized to ATG-3707 activity tested in parallel. As shown, all variants, except C2157D2, exhibited improved Vmax values over ATG-3707. Since C2157D2 was selected for improved brightness in CellTiterGlo® buffer over ATG-3707, it still had beneficial properties. Several of these ATG-3707 variants also exhibited lower Km values for the CS0333 substrate, thus indicating they are likely binding more tightly to the substrate.

TABLE 5

Kinetic analysis of ATG-3707 variants

| | BrightGlo | | Detection Reagent | |
|---|---|---|---|---|
| Enzyme | Vmax (RLU) | Km (uM) | Vmax (RLU) | Km (uM) |
| ATG3707 | 4,240,329 | 6.25 | 3,695,670 | 113.2 |
| C2157D2 | 3,053,170 | 6.31 | 3,677,773 | 97.09 |
| C2158A3 | 4,009,543 | 5.15 | 3,944,016 | 101.1 |
| C2240E2 | 5,559,638 | 3.97 | 5,831,602 | 88.72 |
| C2242E1 | 7,021,077 | 5.81 | 5,366,355 | 108.6 |
| C2260B6 | 4,439,047 | 4.06 | 4,995,834 | 68.16 |
| C2261D1 | 4,702,332 | 5.92 | 4,103,451 | 79.75 |
| C2261D9 | 6,903,348 | 7.46 | 6,756,516 | 116.8 |

Additional screening was performed on the results obtained from the epPCR/DNA shuffling experiments to higher luminescence on one or both of the two substrates tested, with some clones showing a significant increase in brightness.

TABLE 6

Variants exhibiting improved activity with CS0280 and CS0333

| Enzyme | CS0280 | CS0333 |
|---|---|---|
| C4589D5 | 12.42 | 3.79 |
| C4584D9 | 12.41 | 2.67 |
| C4604A11 | 12.16 | 2.41 |
| C4580B10 | 9.35 | 4.64 |
| C4588H8 | 6.56 | 3.90 |
| C4598F8 | 5.88 | 4.91 |
| C4608E7 | 5.26 | 6.86 |
| C4629G5 | 5.06 | 2.26 |
| C4601C8 | 4.53 | 3.32 |
| C4584G5 | 4.39 | 3.42 |
| C4580E9 | 4.00 | 6.51 |
| C4609F7 | 3.90 | 6.04 |
| C4581C3 | 3.88 | 1.04 |
| C4610H6 | 3.67 | 4.15 |
| C4610C10 | 3.60 | 4.32 |

Inhibition of Luciferase Enzyme Variants

FIGS. 20A-20B and 21A-21B show ATG-2624 and ATG-2625 are inhibited by dehydro-F-luciferin, but less so than the thermostable luciferase variant of Ppe of SEQ ID NO: 1, exhibiting enhanced resistant to dehydro-F-luciferin than the thermostable luciferase variant of Ppe of SEQ ID NO: 1, but not completely resistant. FIGS. 20C and 21C provide quantitation of the data in FIGS. 20A-20B and 21A-21B, showing the Ki values for dehydro-F-luciferin for these luciferase enzyme variants in the respective buffers. The higher values for the mutant enzymes confirmed that they are more resistant than the thermostable luciferase variant of Ppe (SEQ ID NO: 1) (i.e., it takes more dehydro-F-luciferin to inhibit them).

Figure 22:
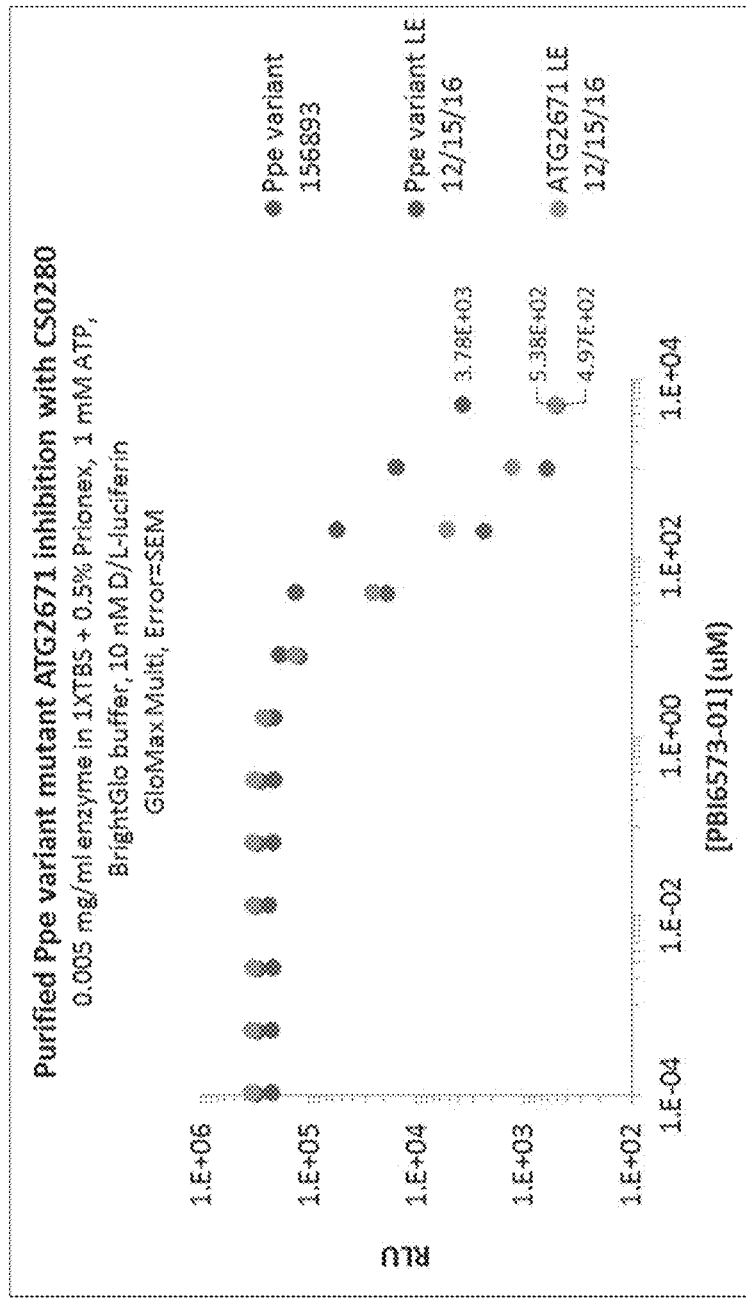
FIG. 22 includes representative results demonstrating the inhibitory effect of CS0280 (dimethyl luciferin) on a thermostable luciferase variant of Ppe (SEQ ID NO: 1) and the ATG-2671 variant.

While previous experiments used a single high concentration of luciferin analog to show inhibition of luciferin-dependent luminescence, the experiment depicted in FIG. 22 tested a concentration range of CS0280 in order to determine the relative amount of analog necessary to see any inhibition; it shows that although ATG-2671 (with its rational mutations, some in the active site) does not have enhanced luminescence activity with luciferin analogs, it is inhibited by CS0280 at lower concentrations suggesting that it binds that this analog more tightly than the thermostable luciferase variant of Ppe of SEQ ID NO: 1.

Figure 23A:
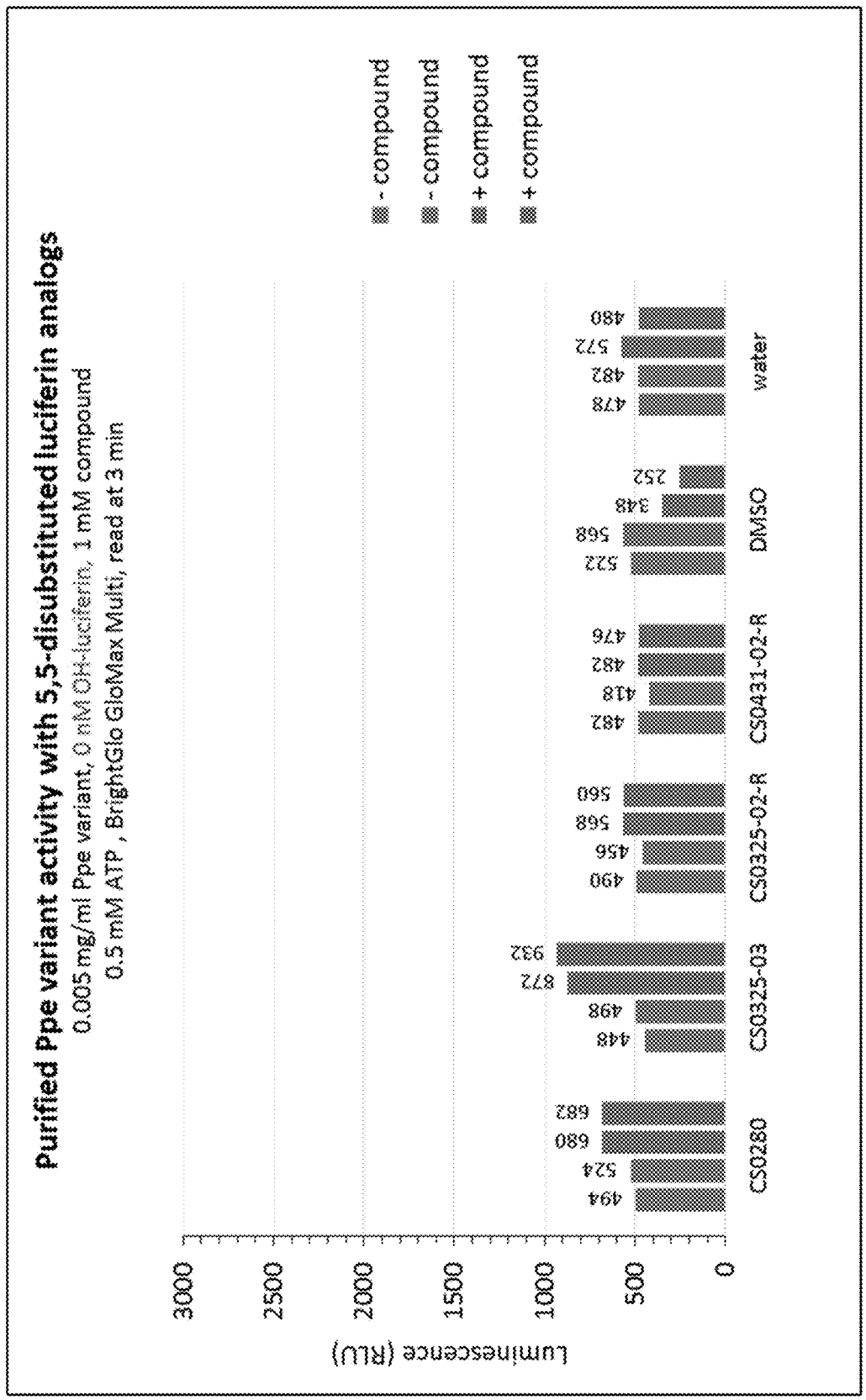
FIGS. 23A-23C include representative results of activity test of a thermostable luciferase variant of Ppe (SEQ ID NO: 1) with and without luciferin and various 5,5-disubstituted luciferin analogs.
Figure 23B:
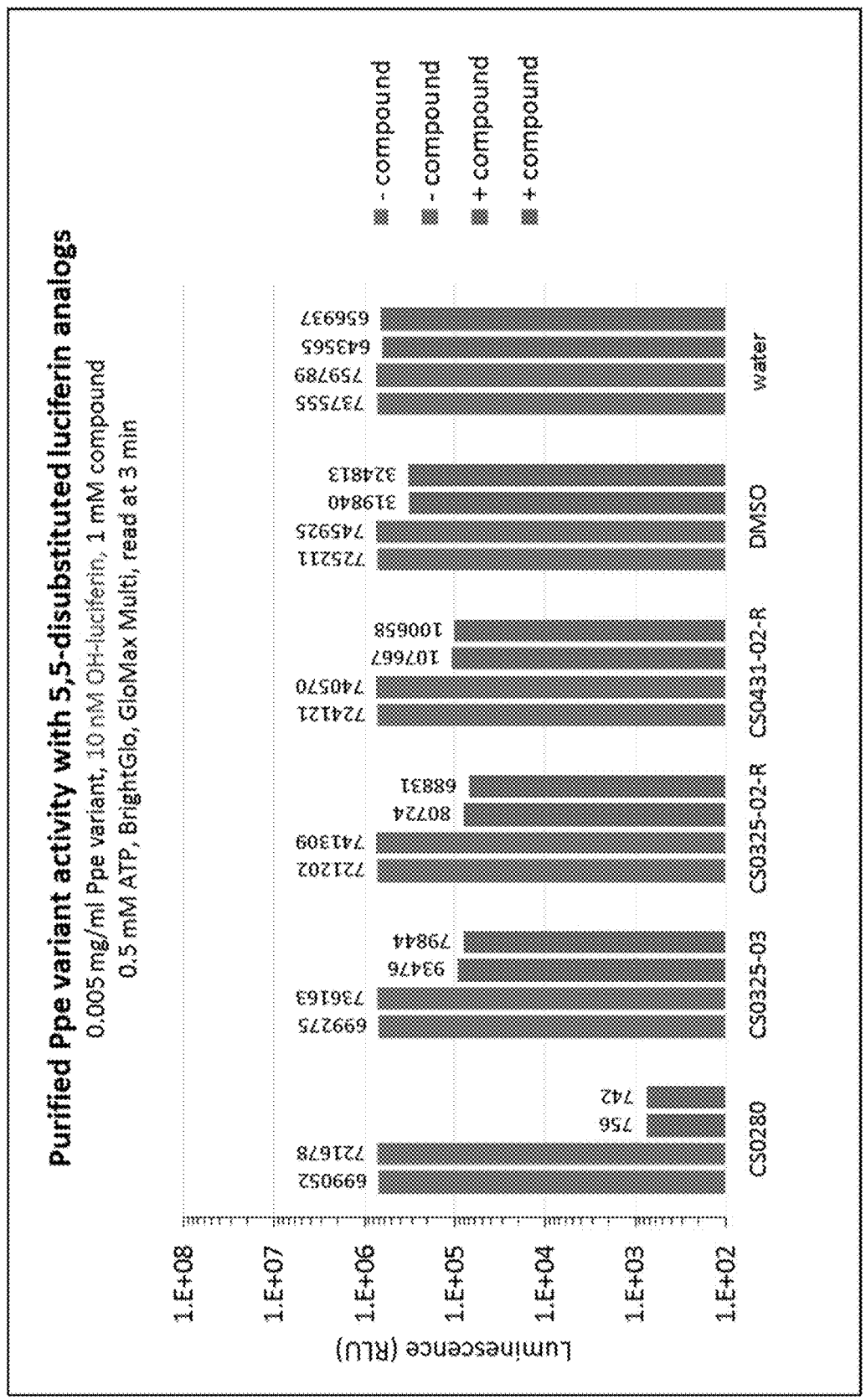
Figure 23C:
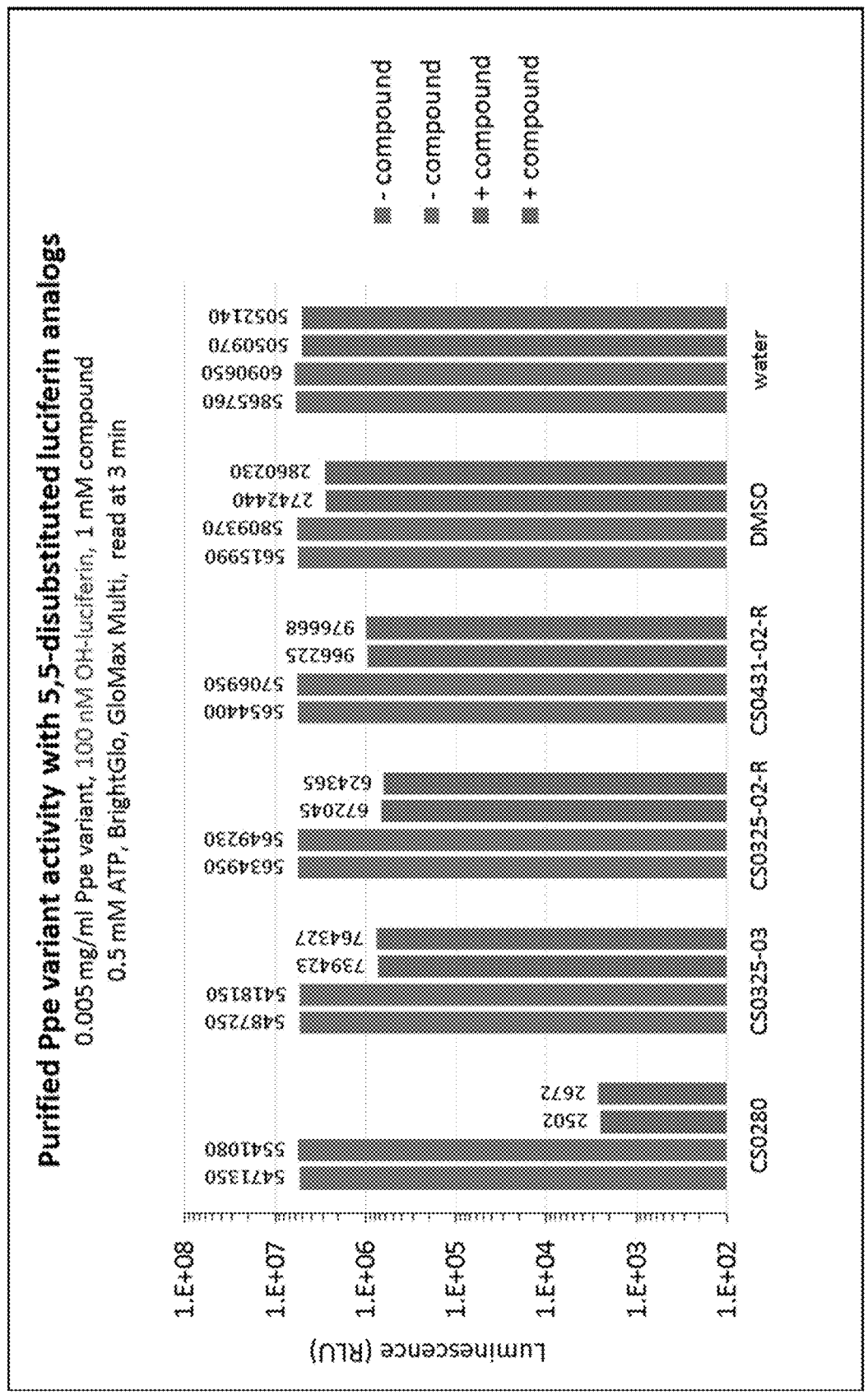

FIGS. 23A-23C include representative results of activity test of the thermostable luciferase variant of Ppe (SEQ ID NO: 1) with and without luciferin and various 5,5-disubstituted luciferin analogs. More specifically, FIGS. 23A-23C tested the inhibition of the thermostable luciferase variant of Ppe (SEQ ID NO: 1) with CS0280-01, CS0325-03, CS0325-02-R, and CS0431-02-R. Reagent compositions included luciferin analog compounds diluted from 50 mM to 20 mM in DMSO. Enzymes were diluted in 1×TBS+1% Prionex to 0.01 mg/ml. Approximately 50 µl luciferin analog compounds in Bright-Glo™ buffer+ATP were combined with 50 µl diluted enzyme in 1×TBS+1% Prionex. Approximately 5 µl of the luciferin analog compounds were added to a final concentration of 1 mM. Enzyme activity was read before and after addition of the luciferin analog compounds. FIG. 23A included 0 nM starting concentration of luciferin; FIG. 23B included 10 nM starting concentration of luciferin; FIG. 23C included 100 nM starting concentration of luciferin. As demonstrated, little to no luminescence is produced by the thermostable luciferase variant of Ppe (SEQ ID NO: 1) with or without the addition of the luciferin analog compounds (FIG. 23A). As the concentration of luciferin increases from 10 nM (FIG. 23B) to 100 nM (FIG. 23C), the reduction in luminescence by the thermostable luciferase variant of Ppe (SEQ ID NO: 1) in the presence of the luciferin analog compounds indicates that they are binding to the thermostable luciferase variant of Ppe (SEQ ID NO: 1) and competing with luciferin.

Figure 24A:
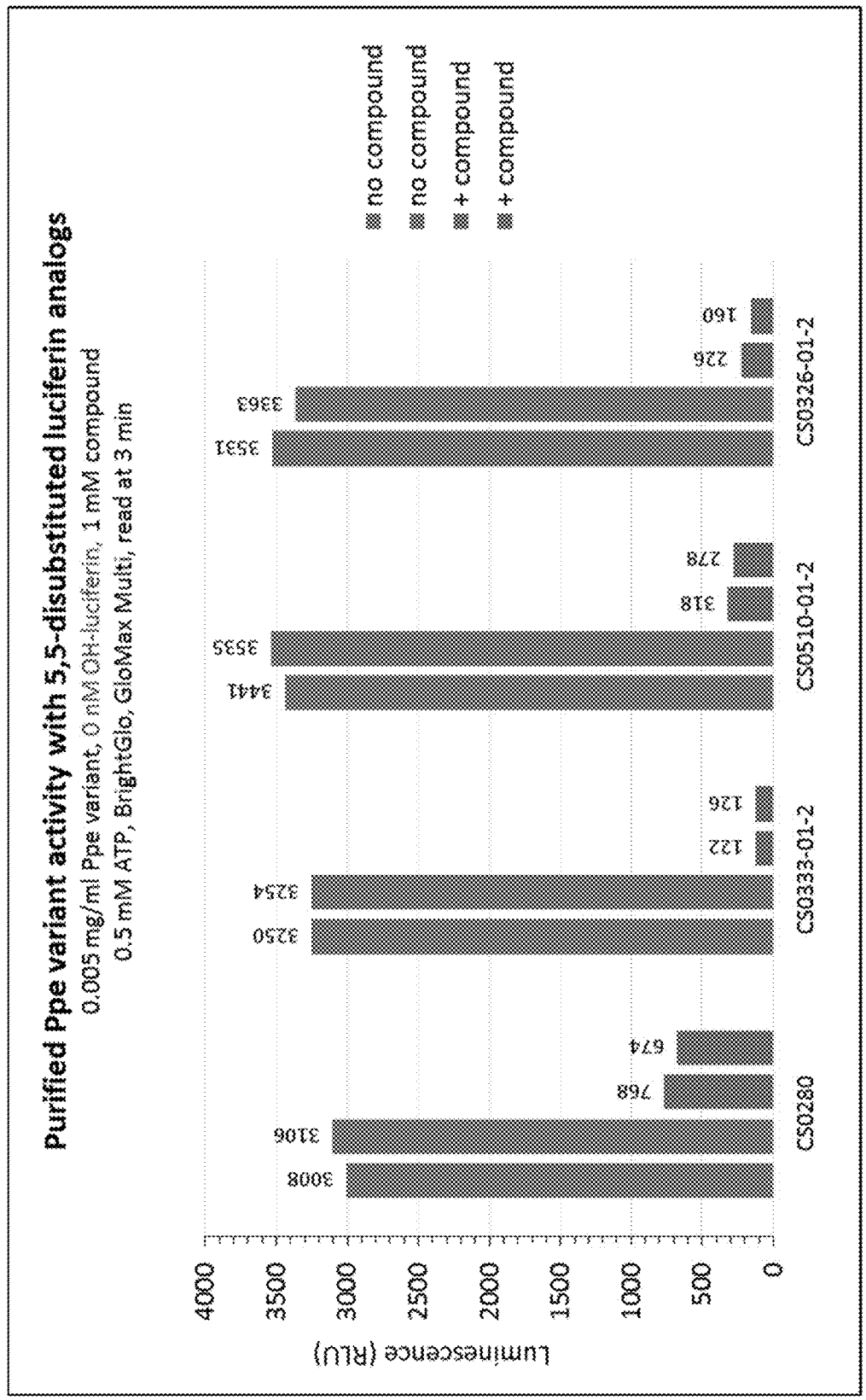
FIGS. 24A-24B include representative results of activity test of a thermostable luciferase variant of Ppe (SEQ ID NO: 1) with and without luciferin and various 5,5-disubstituted luciferin analogs.
Figure 24B:
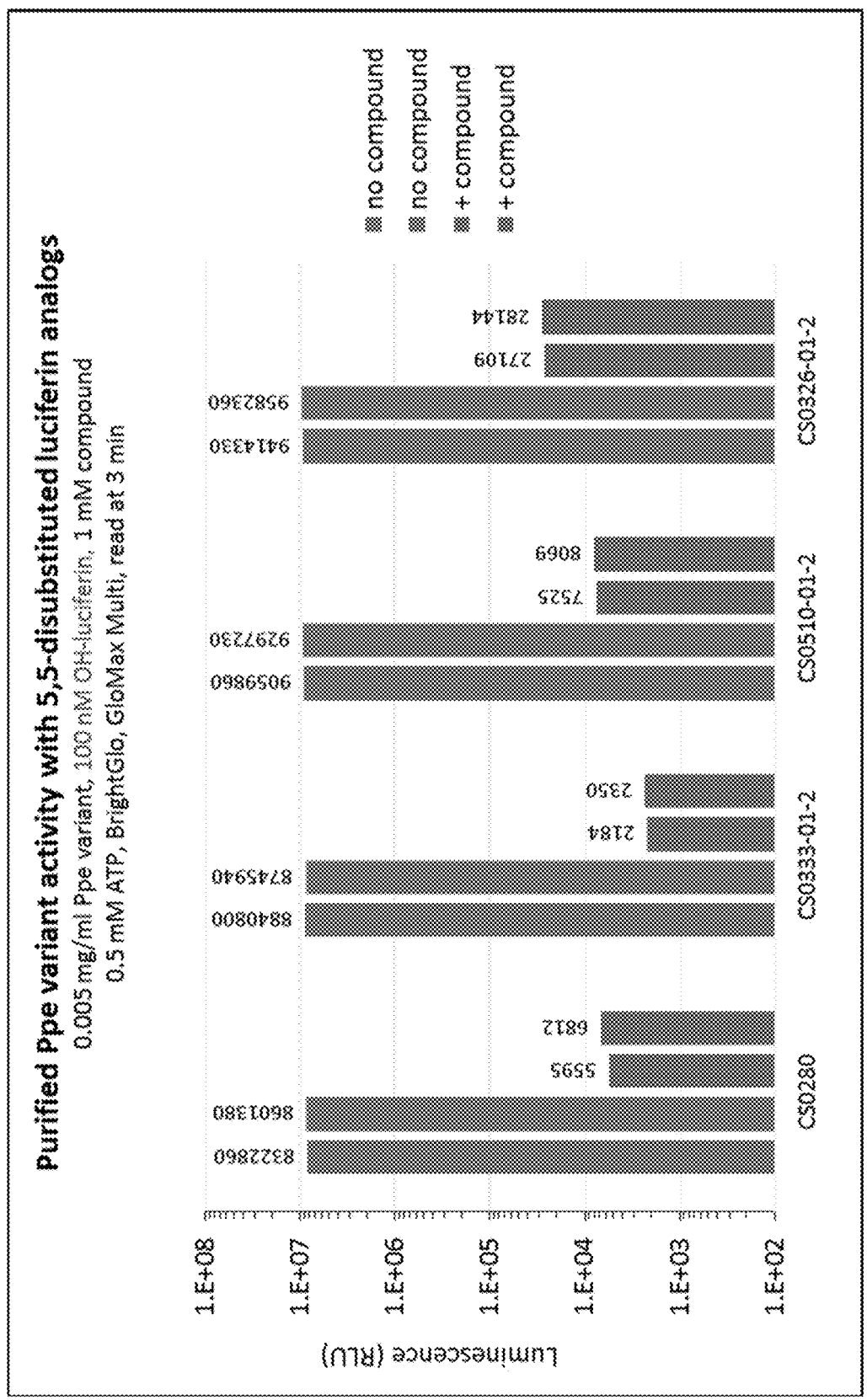

FIGS. 24A-24B include representative results of activity test of the thermostable luciferase variant of Ppe (SEQ ID NO: 1) with and without luciferin and various 5,5-disubstituted luciferin analogs. More specifically FIGS. 24A-24B tested the inhibition of the thermostable luciferase variant of Ppe (SEQ ID NO: 1) with CS0280-01, CS0333-01-2, CS0510-01-2, and CS0326-01-2. Reagent compositions included luciferin analog compounds diluted from 50 mM to 20 mM in DMSO. Enzymes were diluted in 1×TBS+1% Prionex to 0.01 mg/ml. Approximately 50 µl luciferin analog compounds in Bright-Glo™ buffer+ATP were combined with 50 µl diluted enzyme in 1×TBS+1% Prionex. Approximately 5 µl of the luciferin analog compounds were added to a final concentration of 1 mM. Enzyme activity was read before and after addition of the luciferin analog compounds. FIG. 24A included 0 nM starting concentration of luciferin; FIG. 24B included 100 nM starting concentration of luciferin. As demonstrated, as the concentration of luciferin increases from 0 nM (FIG. 24A) to 100 nM (FIG. 24B), the reduction in luminescence by the thermostable luciferase variant of Ppe (SEQ ID NO: 1) in the presence of the luciferin analog compounds indicates that they are binding to the thermostable luciferase variant of Ppe (SEQ ID NO: 1) and competing with luciferin. Also, CS0333 appeared to be the strongest inhibitor suggesting it binds with highest affinity to the thermostable luciferase variant of Ppe of SEQ ID NO: 1.

Given the binding strength of CS0333, further tests were conducted to investigate the ability of its breakdown products to inhibit enzyme activity. More specifically, FIG. 25 includes a summary of Ki values for the thermostable luciferase variant of Ppe of SEQ ID NO: 1, ATG-2889, and ATG-3552 in the presence of CS0333 and its breakdown products. Reagent compositions included 10 nM OH-luciferin, 1 mM ATP, 0.005 mg/ml enzyme, and 0.0032-2380.95 µM dehydro Luc in Bright-Glo™ buffer. Breakdown products of CS0333 include CS0565-1, CS0565-2, CS0565-3, and CS0565-4. As demonstrated in FIG. 25 several of the breakdown products (CS0565-3, CS0565-4) of 5,5-cyclopropyl luciferin are better competitors for the ATG-2889 variant than the thermostable luciferase variant of Ppe (SEQ ID NO: 1) in the presence of racemic luciferin. For ATG-2889, all breakdown products are less inhibitory in the presence of 5,5-cyclopropyl luciferin than luciferin. In addition, all breakdown products have at least 16-fold or lower inhibition when compared against dehydro-OH-luciferin indicating that, although these breakdown products are inhibitory, inhibition is at greater than an order-of-magnitude higher concentration and accumulate more slowly in solution than dehydroluciferin so they should result in improved stability as a complete liquid reagent relative to luciferin-based formulations.

The luciferase enzyme variant ATG-2889 (H244W+T344A+I396K) was used to generate additional luciferase enzyme variants that included the V300G amino acid substitution (ATG-3550, ATG-3551, ATG-3552, and ATG-3553), which conferred resistance to inhibition by dehydro F-luciferin (FIG. 26). Reagent compositions include 0.022 µM-366.97 µM Dehydro F-luciferin titration, 1 mM ATP, 1 µM F-luciferin, and 0.005 mg/ml enzyme. As shown in FIG. 26, all amino acid substitution combinations in the luciferase enzyme variants tested exhibited improved resistance to dehydro F-luciferin as evident by higher $IC_{50}$ values for the inhibitor compared to the thermostable luciferase variant of Ppe (SEQ ID NO: 1) (regardless of buffer used). Both amino acid substitutions L305F and S306P conferred improved resistance to the inhibitor individually and in combination.

Use of Proluciferin 5,5-disubstituted Luciferin Analogs in Enzyme Assays

Figure 27A:
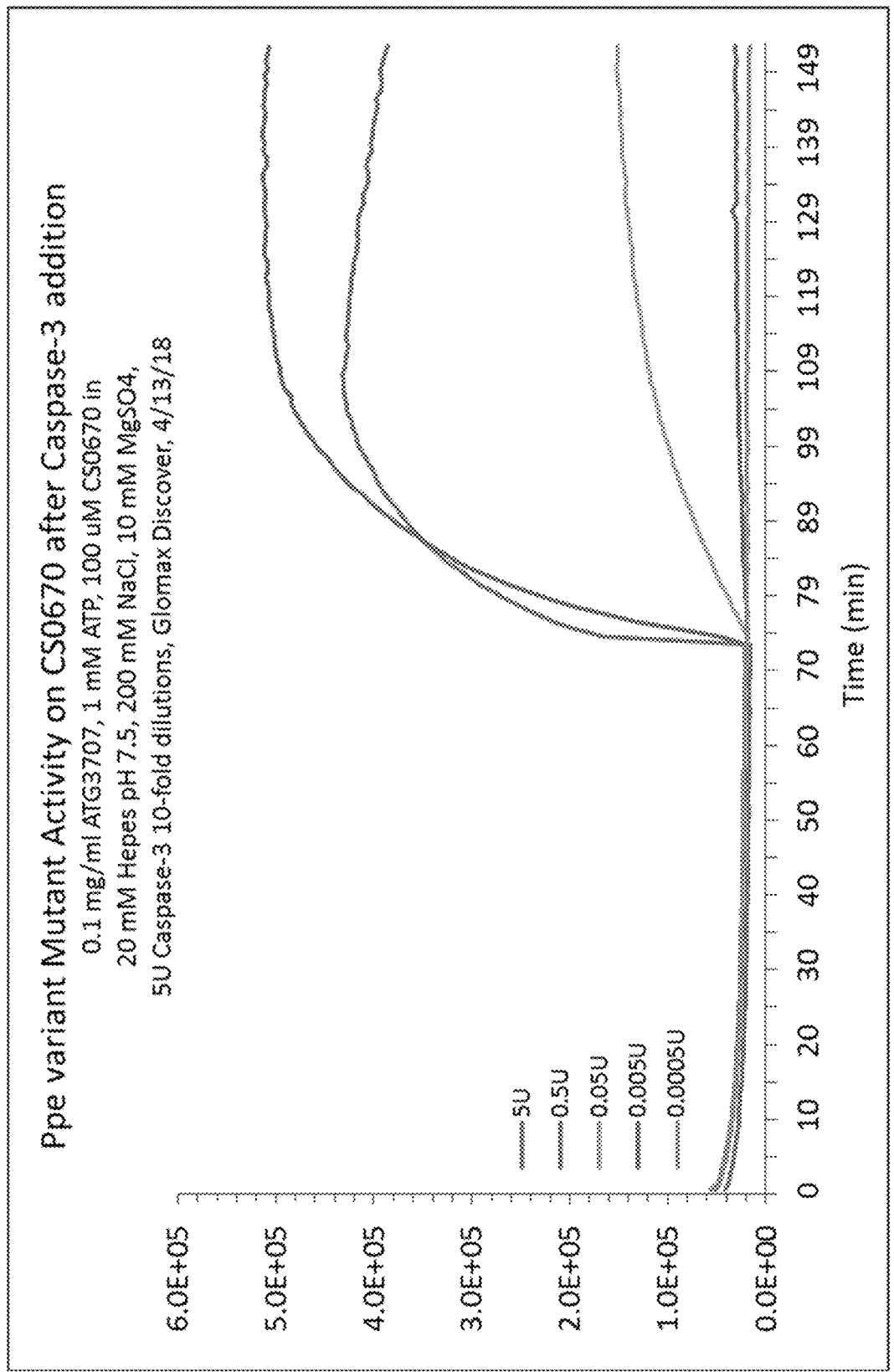
FIG. 27A-27B includes representative results demonstrating the efficacy of proluciferin 5,5-disubstituted luciferin analogs and the ATG-3707 variant in Caspase-3 activation assays.
Figure 27B:
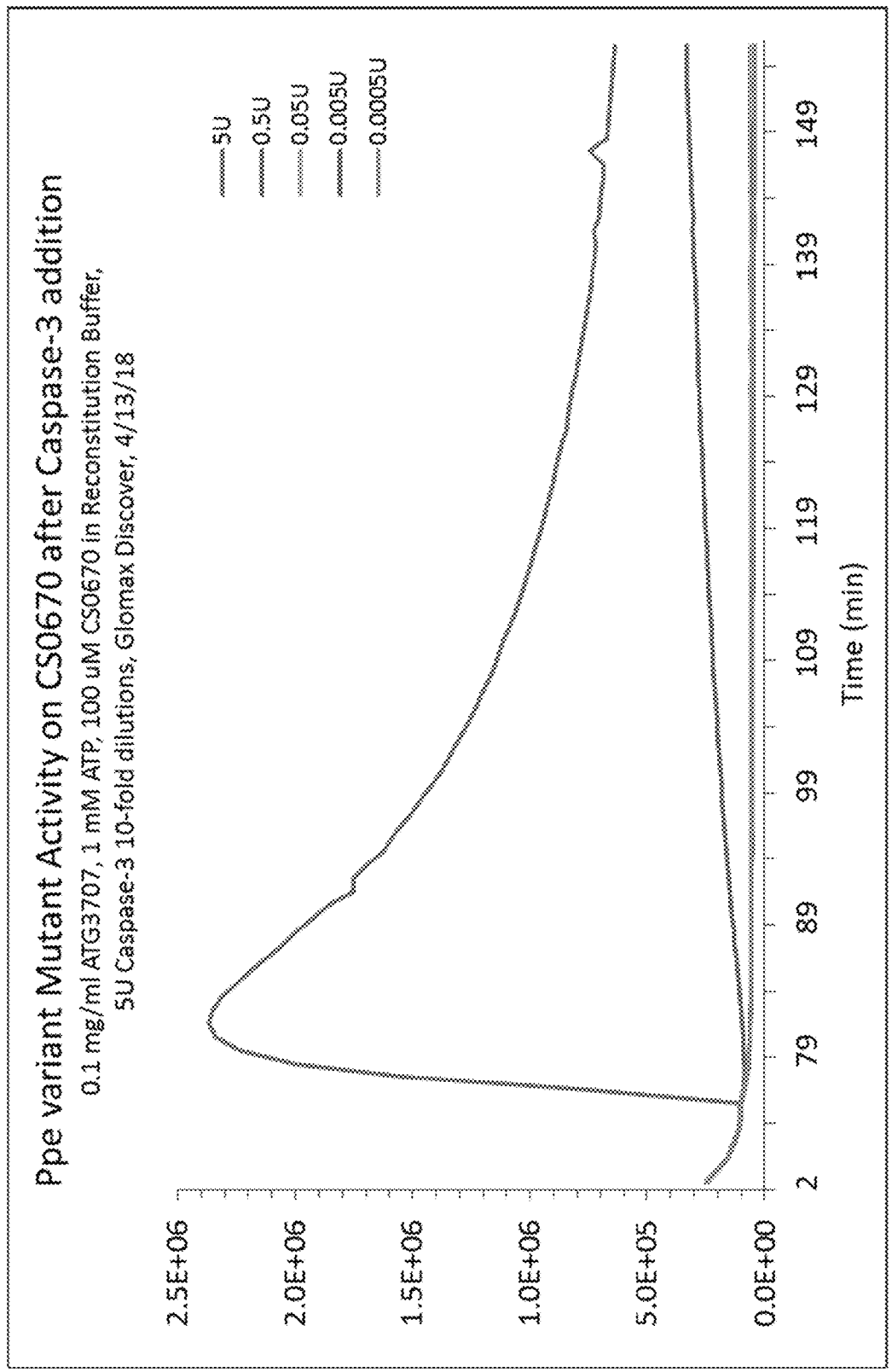

Proluciferin versions of luciferin analogs can also be used with enzymes (e.g., Caspase-3, β-glucosidase, and the like) that activate the proluciferin by degrading it to separate the modification moiety from the luciferin or luciferin analog, which then serves as a luminogenic substrate for the luciferase enzyme variants described herein. FIG. 27A-27B includes representative results demonstrating the efficacy of proluciferin 5,5-disubstituted luciferin analogs and the ATG-3707 variant in Caspase-3 activation assays. Reagent compositions included luciferin analog compounds diluted from 50 mM to 1 mM in 20 mM HEPES pH 7.5, 200 mM NaCl, 10 mM $MgSO_4$, 2 mM ATP. ATG-3707 was diluted in 20 mM HEPES pH 7.5, 200 mM NaCl, 10 mM $MgSO_4$ to 0.2 mg/ml. Caspase-3 was serially diluted 10-fold from 1 U/µl down to 0.001 U/µl in 20 mM HEPES, pH 7.5, 200 mM NaCl, 10 mM $MgSO_4$. Next, 50 µl diluted ATG-3707 was combined with 50 µl diluted CS0670+ATP mix. (Reconstitution Buffer (100 mM MES pH 6.5, 5 mM $MgCl_2$, 0.2% Tergitol, 0.002% Sodium Azide) was used in FIG. 27B instead of the HEPES-based buffers in FIG. 27A.) The reaction was incubated at 25° C. for 73 min, taking luminescence measurements every 60 seconds. Approximately 50 µl of each serial dilution of Caspase-3 was added to the reaction and mixed, and the luminescence measured every 60 seconds for a total experimental time of 152 minutes. As shown, luminescence increased after addition of Caspase-3, which facilitated the separation of the CS0670 analog from its corresponding precursor, allowing for activation of ATG-3707. Thus, proluciferin analogs (e.g., cyclopropyl analogs) can be effective substrates for the luciferase variants described herein.

Figure 28A:
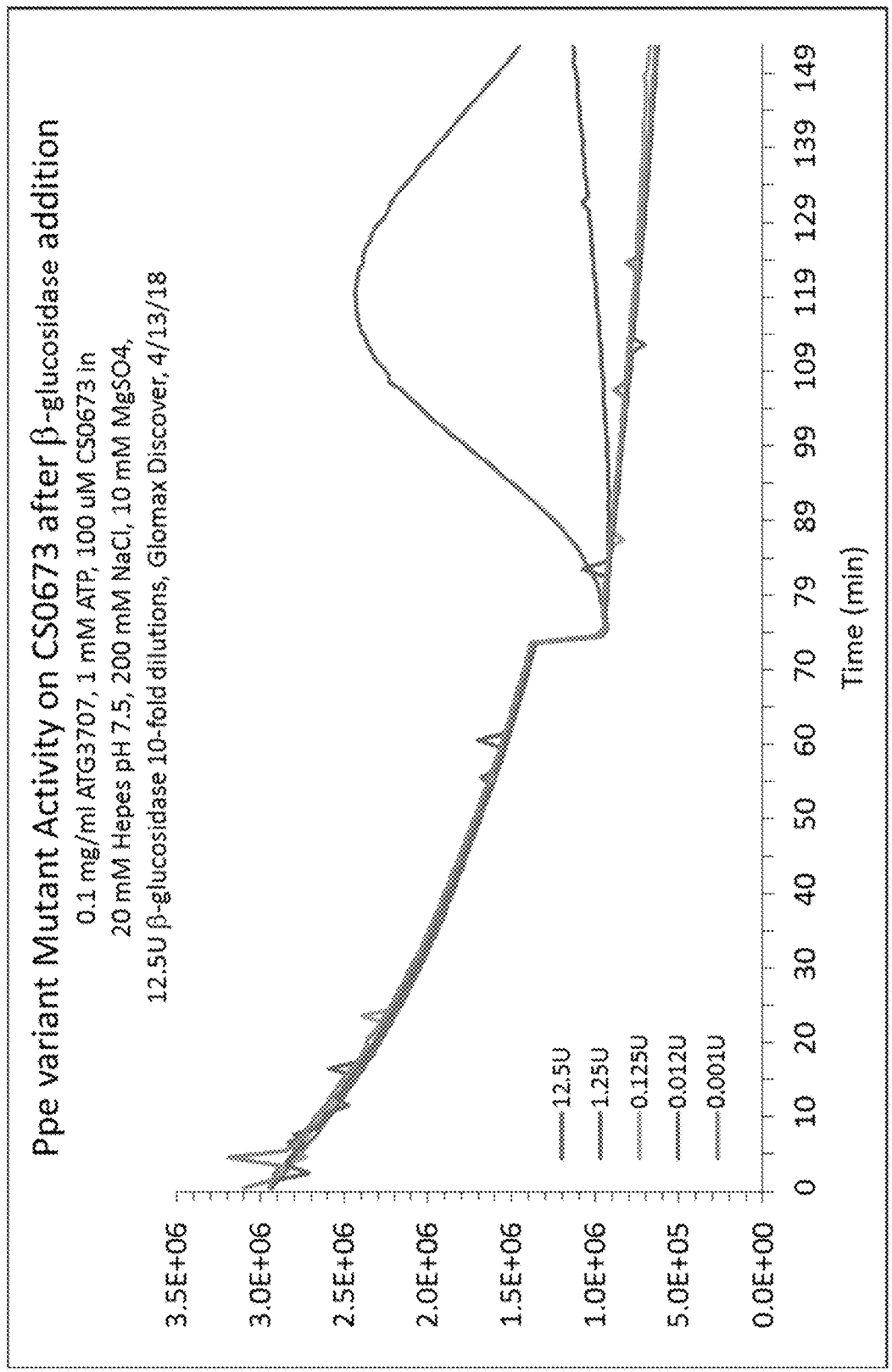
FIG. 28A-28B includes representative results demonstrating the efficacy of proluciferin 5,5-disubstituted luciferin analogs and the ATG-3707 variant in β-glucosidase activation assays.
Figure 28B:
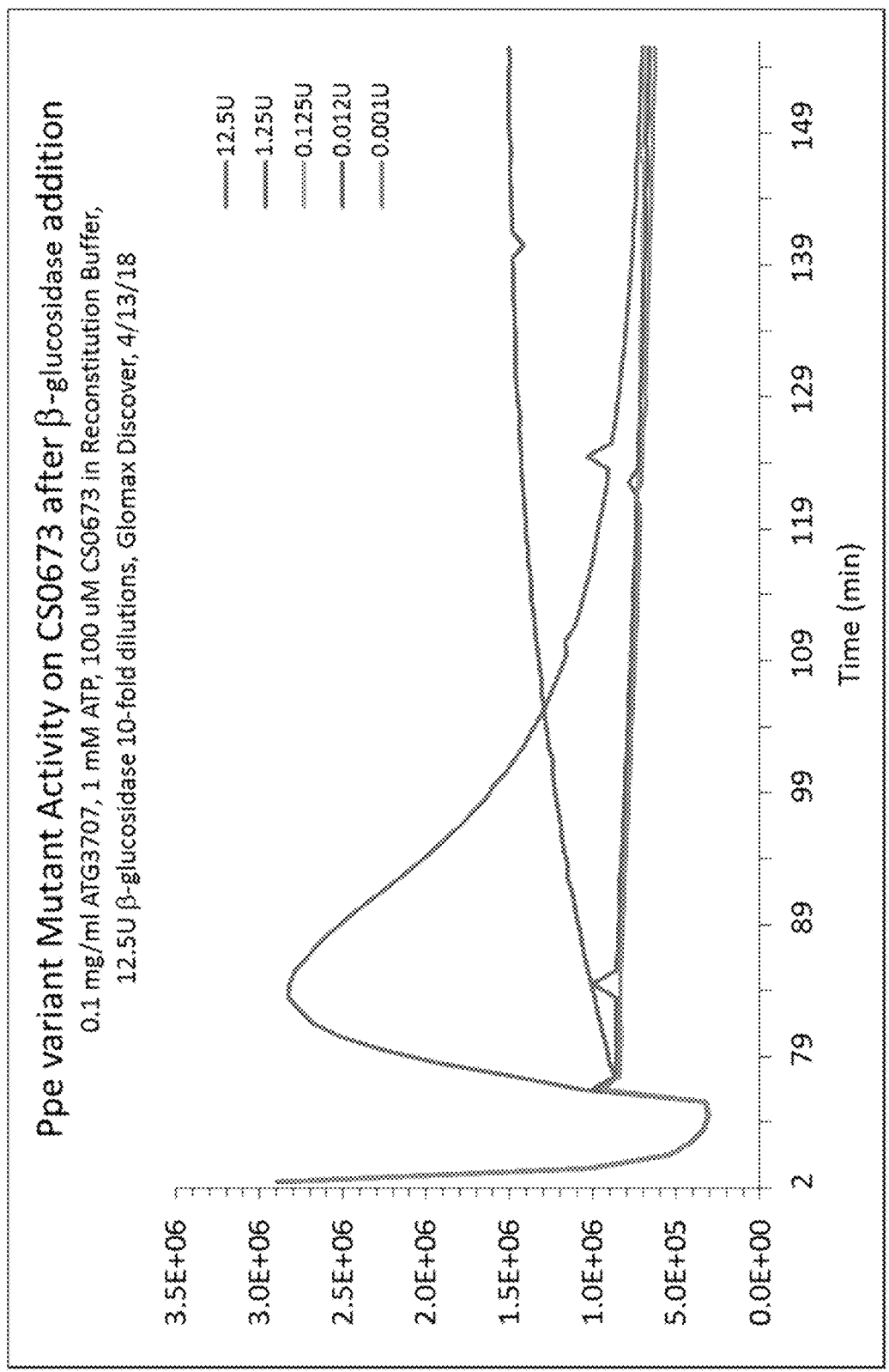

FIG. 28A-28B includes representative results demonstrating the efficacy of proluciferin 5,5-disubstituted luciferin analogs and the ATG-3707 variant in β-glucosidase activation assays. Reagent compositions included luciferin analog compounds diluted from 50 mM to 1 mM in 20 mM HEPES pH 7.5, 200 mM NaCl, 10 mM MgSO₄, 2 mM ATP. ATG-3707 was diluted in 20 mM HEPES pH 7.5, 200 mM NaCl, 10 mM MgSO₄ to 0.2 mg/ml. β-glucosidase was serially diluted 10-fold from 2500 U/µl down to 2.5 U/µl in 20 mM HEPES pH 7.5, 200 mM NaCl, 10 mM MgSO₄. Next, 50 µl diluted ATG-3707 was combined with 50 µl diluted CS0673+ATP mix. (Reconstitution Buffer (100 mM MES pH 6.5, 5 mM MgCl₂, 0.2% Tergitol, 0.002% Sodium Azide) was used in FIG. 28B instead of the HEPES-based buffers in FIG. 28A.) The reaction was incubated at 25° C. for 73 min taking luminescence measurements every 60 seconds. Approximately 50 µl of each serial dilution of β-glucosidase was added to the reaction and mixed, and the luminescence measured every 60 seconds for a total experimental time of 152 minutes. As shown, luminescence increased after addition of β-glucosidase, which facilitated the separation of the CS0673 analog from its corresponding precursor, allowing for activation of ATG-3707. Thus, proluciferin analogs (e.g., cyclopropyl analogs) can be effective substrates for the luciferase variants described herein.

Differential Scanning Fluorimetry (DSF) analysis

Figure 29:
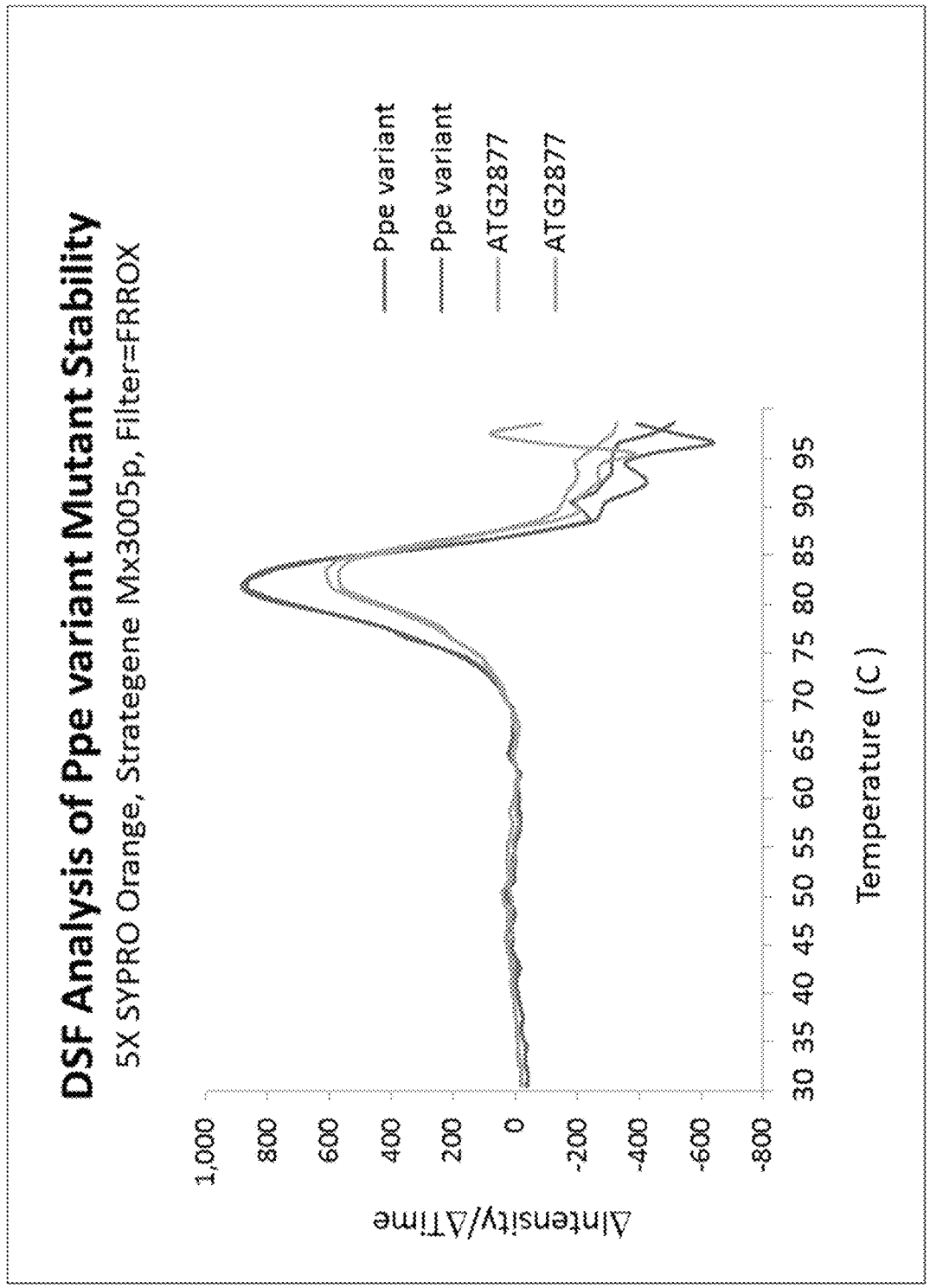
FIG. 29 includes representative results of differential scanning fluorimetry (DSF) analysis on a thermostable luciferase variant of Ppe (SEQ ID NO: 1) and the ATG-2877 variant.

FIG. 29 includes representative results of differential scanning fluorimetry (DSF) analysis on a thermostable luciferase variant of Ppe (SEQ ID NO: 1) and the ATG-2877 variant. To conduct the experiment, Sypro Orange (5000×) was diluted in water to 3× and combined with enzymes stored in 50 mM HEPES pH 7.5, 100 mM NaCl, 2 mM EDTA to a final concentration of 5×. Fluorescence was read at 60 second intervals as the reactions were heated at 1° C. per minute from 30-95° C. The change in fluorescence at each minute was calculated and plotted for each temperature in the range. As shown, the H244W amino acid substitution in ATG-2877 does not alter the transition melting temperature of the purified protein by DSF analysis, indicating this amino acid substation does not cause a loss change in thermostability. Evaluation of Luciferase Enzyme Variants Additional luciferase enzyme variants were generated and evaluated for their stability and activity. To evaluate the additional luciferase enzyme variants, 0.005 mg/ml luciferase enzyme variant was mixed with 1 mM ATP+1 mM substrate in either Bright-Glo™ (BG) or Detection Reagent (DR) buffers. As shown in FIG. 30 and Table 7 below, several variants showed improved brightness with CS0280 and CS0333 substrates over ATG-3707. (FIG. 30 is colored according to their relative luminescence values within each column across a red to green color spectrum with the lowest values colored red and the highest values colored green.)

TABLE 7

Variants exhibiting improved activity with CS0280 and CS0333

| | CS0333 | | CS0280 | | Fold improvement over ATG3707 | | | | DSF Tm |
| | | | | | CS0333 | | CS0280 | | |
| Enyme | DR | BG | DR | BG | DR | BG | DR | BG | (° C.) |
|---|---|---|---|---|---|---|---|---|---|
| C8523E12 | 15,418,100 | 20,331,700 | 213,031 | 1,996,020 | 3.62 | 3.82 | 7.29 | 2.52 | 67 |
| C9715F9 | 14,484,700 | 18,891,000 | 245,081 | 2,040,340 | 3.40 | 3.55 | 8.38 | 2.57 | 68 |
| C9673G4 | 12,268,900 | 18,508,700 | 104,671 | 1,298,420 | 2.88 | 3.48 | 3.58 | 1.64 | 71 |
| C9674C3 | 12,054,200 | 17,906,800 | 114,556 | 1,346,470 | 2.83 | 3.36 | 3.92 | 1.70 | 71 |
| C9683H6 | 13,829,900 | 17,507,200 | 113,078 | 1,799,410 | 3.24 | 3.29 | 3.87 | 2.27 | 66 |
| C9644H7 | 11,887,900 | 15,784,700 | 83,763 | 1,642,120 | 2.79 | 2.97 | 2.87 | 2.07 | 59 |
| C9649G7 | 11,733,600 | 13,322,000 | 891,010 | 7,501,350 | 2.75 | 2.50 | 30.48 | 9.46 | 51 |
| C9679H10 | 11,647,400 | 12,508,600 | 984,923 | 7,349,470 | 2.73 | 2.35 | 33.69 | 9.26 | 65 |
| C9671D10 | 7,772,660 | 8,464,030 | 1,439,510 | 11,877,500 | 1.82 | 1.59 | 49.24 | 14.97 | 65 |

The luciferase enzyme variants generated were also evaluated using DSF analysis as shown in the representative results provided in FIG. 30 and Table 7 above. To conduct the experiments, Sypro Orange (5000×) was diluted in water to 3× and combined with enzymes stored in 20 mM HEPES pH 7.5, 200 mM NaCl, 1 mM EDTA to a final concentration of 5×. Fluorescence was read at 60 second intervals as the reactions were heated at 1° C. per minute from 30-95° C. The change in fluorescence at each minute was calculated and plotted for each temperature in the range. As demonstrated by these data, several of the enzyme variants exhibited improved brightness while retaining thermostability relative to ATG-3707.

Kinetic tests of these luciferase enzyme variants were also conducted. To test if the luciferase enzyme variants identified exhibited improved activity, the Vmax and $K_m$ for the thermostable luciferase variant of Ppe (SEQ ID NO: 1), ATG-3707, and ATG-4117 were compared. Reagent compositions included 0.005 mg/ml luciferase enzyme variant+1 mM ATP, and 0.1 fM to 1 mM substrate in Bright-Glo™ (BG) or Detection Reagent (DR) buffers. The composition was incubated for 3 mins and read on GloMax® Multi+ platform.

Table 8 below includes representative results of kinetic analysis of the thermostable luciferase variants of Ppe (SEQ ID NO: 1), ATG-3707, and ATG-4117. The Ppe variant (SEQ ID NO: 1) was tested with D/L-luciferin, and ATG-3707, and ATG-4117 were tested with CS0280 and CS0333. As demonstrated, ATG-4117 exhibited higher maximum luminescence (Vmax) with luciferin analogs CS0280 and CS0333 relative to ATG-3707.

TABLE 8

Activity of ATG3707 and ATG4117 with CS0280 and CS0333

| Substrate | Buffer | Enzyme | Km (uM) | Vmax (RLU) |
|---|---|---|---|---|
| D/L-luciferin | BrightGlo | Ppe variant | 0.4659 | 23,226,184 |
| | | ATG3707 | 0.02717 | 2,596,835 |
| | | ATG4117 | 0.0702 | 719,605 |
| | Detection Reagent | Ppe variant | 10.97 | 12,592,733 |
| | | ATG3707 | 1.18 | 6,820,106 |
| | | ATG4117 | 2.647 | 817,287 |
| CS0280 | BrightGlo | ATG3707 | 4.532 | 5,791,823 |
| | | ATG4117 | 12.95 | 7,188,109 |
| | Detection | ATG3707 | 93.5 | 4,706,312 |

TABLE 8-continued

Activity of ATG3707 and ATG4117 with CS0280 and CS0333

| Substrate | Buffer | Enzyme | Km (uM) | Vmax (RLU) |
|---|---|---|---|---|
| CS0333 | Reagent BrightGlo | ATG4117 | 419.4 | 7,879,793 |
| | | ATG3707 | 3.61 | 828,567 |
| | | ATG4117 | 12.44 | 1,601,921 |
| | Detection Reagent | ATG3707 | 148.1 | 42,242 |
| | | ATG4117 | 757.7 | 124,964 |

Experiments were also conducted to evaluate and compare the activities of the various luciferase enzyme variants, including the effects of individual amino acid mutations. To evaluate the effect of individual mutations on luciferase enzyme variants, 0.005 mg/ml luciferase enzyme variant was mixed with 1 mM ATP+10 fM to 1 mM CS0333 in Detection Reagent (DR) buffer. As shown in Tables 9A and 9B below, introducing single point mutations comprising ATG-3707 into the Ppe variant did not significantly increase its maximum luminescence with CS0333, with the exception of the H244W mutation, which showed an approximate 5-fold improvement above background. Alternatively, removing individual point mutations from those comprising ATG-3707 showed the contribution of individual mutations on maximum luminescence with CS0333. The H244W and T344A substitutions showed the largest decrease in activity with CS0333 upon their substitution back to the amino acids originally in the Ppe variant.

TABLE 9A

Effects of individual amino acid substitutions and various combinations of amino acid substitutions on luciferase enzyme variants with CS0333

| Enzyme | DSF Tm (° C.) | Vmax (RLU) with CS0333 |
|---|---|---|
| Ppe variant | 79 | — |
| MK0108 | 78 | 1,300 |
| MK0109 | 77 | 1,114 |
| MK0110 | 80 | 9,534 |
| MK0111 | 79 | 1,166 |
| MK0112 | 80 | 1,232 |
| MK0113 | 71 | 1,948 |
| MK0114 | 70 | 1,030 |
| MK0115 | 67 | 2,120 |
| MK0116 | 73 | 7,428 |
| MK0117 | 63 | 3,820,310 |
| MK0118 | 63 | 3,455,610 |
| MK0119 | 64 | 62,167 |
| MK0120 | 62 | 3,192,740 |
| MK0121 | 62 | 2,643,970 |
| MK0122 | 69 | 962,171 |
| MK0123 | 72 | 2,841,640 |
| MK0124 | 70 | 4,270,690 |
| MK0125 | 69 | 2,625,480 |
| MK0127 | 66 | 2,293,340 |
| MK0131 | 75 | 2,480,580 |
| MK0132 | 74 | 1,880,200 |

TABLE 9B

Effects of individual amino acid substitutions and various combinations of amino acid substitutions on luciferase enzyme variants with CS0333

| Enzyme | DSF Tm (° C.) |
|---|---|
| MK0130 | 78 |
| MK0133 | 59 |
| MK0134 | 57 |
| MK0135 | 78 |
| MK0136 | 71 |
| MK0137 | 69 |
| MK0138 | 58 |

Kinetic Tests of Luciferase Enzyme Variants

Experiments were also conducted to evaluate the activities (i.e. Vmax and Km) of the various thermostable luciferase variants of Ppe (SEQ ID NO: 1) described above. Representative results of these experiments are provided in the Tables below.

Tables 10 and 11 include representative results of kinetic analysis of the thermostable variants with D/L luciferin, CS0333, and CS0280. As shown, MK0133 is a representative variant that exhibited the unexpected property of maximum luminescence (Vmax) values with CS0333 that are greater than the Ppe variant with D/L-luciferin in Bright-Glo™ and Detection Reagent buffers. MK0134 exhibited a similar high activity, but is more specific for CS0280 and approximated the brightness of the Ppe variant-D/L-luciferin combination in Bright-Glo™ buffer. MK0135 and MK0137 have amino acid substitutions that improve thermostability relative to MK0133 and MK0134, respectively, while retaining activity on the luciferin analogs CS0333 and CS0280.

TABLE 10

Reagent compositions included 0.005 mg/ml luciferase enzyme variant + 1 mM ATP, and 100 fM to 1 mM substrate in Bright-Glo ™ or Detection Reagent buffer. The composition was incubated for 3 mins and read on GloMax ® Multi + platform.

| Buffer | Substrate | Enzyme | Vmax (RLU) | Km (uM) |
|---|---|---|---|---|
| BrightGlo Buffer | D/L-luciferin | Ppe variant | 18,332,536 | 0.6671 |
| | | MK133 | 1,361,878 | 0.1301 |
| | | MK135 | 490,914 | 0.1573 |
| | | MK134 | 377,267 | 0.02566 |
| | | MK137 | 279,889 | 0.03682 |
| BrightGlo Butter | CS0333 | MK133 | 27,149,096 | 14.03 |
| | | MK135 | 4,782,661 | 43.41 |
| | | MK134 | 11,167,451 | 2.241 |
| | | MK137 | 5,453,269 | 7.166 |
| BrightGlo Butter | CS0280 | MK133 | 2,774,469 | 5.359 |
| | | MK135 | 343,822 | 22.03 |
| | | MK134 | 15,499,640 | 1.211 |
| | | MK137 | 2,255,088 | 2.922 |
| Detection Reagent Buffer | D/L-luciferin | Ppe variant | 9,350,431 | 9.382 |
| | | MK133 | 1,545,274 | 0.9928 |
| | | MK135 | 93,531 | 0.7455 |
| | | MK134 | 430,060 | 0.1605 |
| | | MK137 | 40,917 | 0.1957 |
| Detection Reagent Buffer | CS0333 | MK133 | 21,861,957 | 77.38 |
| | | MK135 | 1,018,125 | 509.4 |
| | | MK134 | 9,278,637 | 26.53 |
| | | MK137 | 3,679,125 | 80.51 |
| Detection Reagent Buffer | CS0280 | MK133 | 266,359 | 41.6 |
| | | MK135 | 15,983 | 150.3 |
| | | MK134 | 1,208,016 | 6.123 |
| | | MK137 | 109,120 | 18.86 |

TABLE 11

Reagent compositions included 0.005 mg/ml luciferase enzyme variant + 1 mM ATP, and 1 mM substrate in Bright-Glo ™ or Detection Reagent buffer. The composition was incubated for 3 mins and read on GloMax ® Multi + platform.

| | Vmax (RLU) | | | | | |
|---|---|---|---|---|---|---|
| | D/L-luciferin | | CS0333 | | CS0280 | |
| | BrightGlo Buffer | Detection Reagent Buffer | BrightGlo Buffer | Detection Reagent Buffer | BrightGlo Buffer | Detection Reagent Buffer |
| Ppe variant | 30,177,800 | 17,201,600 | 862 | 724 | 3,689 | 394 |
| MK137 | 326,347 | 48,315 | 3,882,620 | 3,127,710 | 1,931,470 | 117,973 |
| MK148 | 1,227,230 | 515,688 | 3,525,730 | 2,139,740 | 620,182 | 21,505 |
| MK149 | 416,355 | 52,341 | 1,433,640 | 1,270,240 | 1,368,890 | 57,404 |
| MK151 | 1,074,780 | 249,347 | 8,608,150 | 4,805,980 | 1,490,130 | 76,615 |
| MK152 | 954,983 | 103,199 | 405,859 | 175,261 | 484,293 | 11,418 |
| MK153 | 509,406 | 78,859 | 3,768,010 | 2,570,070 | 1,803,730 | 90,671 |
| MK154 | 2,583,340 | 576,293 | 2,374,950 | 854,223 | 809,566 | 22,493 |
| MK155 | 851,342 | 74,704 | 3,609,390 | 1,400,780 | 4,644,970 | 62,606 |
| MK156 | 796,344 | 173,238 | 828,634 | 377,642 | 753,523 | 16,392 |
| MK157 | 573,187 | 75,012 | 4,827,260 | 3,810,820 | 3,598,730 | 159,336 |
| MK158 | 3,261,120 | 1,086,510 | 4,043,790 | 1,508,370 | 1,523,240 | 41,712 |
| MK159 | 688,326 | 106,195 | 6,850,630 | 4,630,740 | 2,094,150 | 110,050 |

Table 12 includes representative results of kinetic analysis of the thermostable variants with 400 fM-4 mM CS0280. This panel of enzyme variants have a combination of improved thermostability and brightness with CS0280 relative to their progenitor enzyme variants MK134 and MK137.

TABLE 12

Reagent compositions included 0.005 mg/ml luciferase enzyme variant + 4 mM ATP, and 400 fM to 4 mM substrate in Bright-Glo ™ or Detection Reagent buffer. The composition was incubated for 3 mins and read on GloMax ® Multi + platform.

| | BrightGlo Buffer | | Detection Reagent Buffer | | |
|---|---|---|---|---|---|
| Enzyme | Vmax (RLU) | Km (uM) | Vmax (RLU) | Km (uM) | DSF Tm (° C.) |
| MK139 | 764,421 | 15.73 | 35,633 | 127.6 | 72 |
| MK141 | 1,701,019 | 7.12 | 89,238 | 40.56 | 73 |
| MK142 | 1,409,786 | 4.98 | 70,257 | 32.32 | 71 |
| MK144 | 1,586,262 | 10.50 | 43,744 | 35.4 | 73 |
| MK145 | 1,193,838 | 11.93 | 66,768 | 50.64 | 72 |
| MK146 | 1,114,607 | 4.21 | 55,964 | 33.3 | 72 |
| MK147 | 1,101,042 | 7.12 | 62,099 | 26.06 | 71 |

Tables 13 and 14 include representative results of kinetic analysis of the thermostable variants with D/L luciferin, CS0333, and CS0280. The panel of enzyme variants highlight amino acid substitutions that further improve upon MK0137 in maximum luminescence (Vmax) or Km in different buffers with the different substrates tested (D/L-luciferin, CS0333, and CS0280). In particular, enzyme variants MK0151 and MK0153 show improvements relative to MK0137 across multiple buffers with multiple substrates.

TABLE 13

Reagent compositions included 0.005 mg/ml luciferase enzyme variant + 2 mM ATP, and 200 fM to 2 mM substrate in Detection Reagent buffer. The composition was incubated for 3 mins and read on GloMax ® Multi + platform.

| Buffer | Substrate | Enzyme | Vmax (RLU) | Km (uM) |
|---|---|---|---|---|
| Detection Reagent Buffer | D/L-luciferin | Ppe variant | 5,686,042 | 28.33 |

TABLE 13-continued

Reagent compositions included 0.005 mg/ml luciferase enzyme variant + 2 mM ATP, and 200 fM to 2 mM substrate in Detection Reagent buffer. The composition was incubated for 3 mins and read on GloMax ® Multi + platform.

| Buffer | Substrate | Enzyme | Vmax (RLU) | Km (uM) |
|---|---|---|---|---|
| Detection Reagent Buffer | D/L-luciferin | ATG4254 | 157,823 | 1.187 |
| Detection Reagent Buffer | D/L-luciferin | MK0137 | 29,013 | 0.3058 |
| Detection Reagent Buffer | D/L-luciferin | MK0148 | 332,703 | 0.21 |
| Detection Reagent Buffer | D/L-luciferin | MK0149 | 33,641 | 0.2597 |
| Detection Reagent Buffer | D/L-luciferin | MK0151 | 123,752 | 0.2648 |
| Detection Reagent Buffer | D/L-luciferin | MK0152 | 60,231 | 0.3946 |
| Detection Reagent Buffer | D/L-luciferin | MK0153 | 75,581 | 0.4352 |
| Detection Reagent Buffer | D/L-luciferin | MK0154 | 342,134 | 0.3558 |
| Detection Reagent Buffer | D/L-luciferin | MK0155 | 22,671 | 0.5268 |
| Detection Reagent Buffer | D/L-luciferin | MK0156 | 144,242 | 0.3734 |
| Detection Reagent Buffer | D/L-luciferin | MK0157 | 32,485 | 0.2704 |
| Detection Reagent Buffer | D/L-luciferin | MK0158 | 365,701 | 0.4511 |
| Detection Reagent Buffer | D/L-luciferin | MK0159 | 369,822 | 0.4439 |
| Detection Reagent Buffer | D/L-luciferin | MK0145 | 41,310 | 0.227 |
| Detection Reagent Buffer | CS0333 | ATG4254 | 884,623 | 1451 |
| Detection Reagent Buffer | CS0333 | MK0137 | 668,831 | 18.83 |
| Detection Reagent Buffer | CS0333 | MK0148 | 543,865 | 48.43 |
| Detection Reagent Buffer | CS0333 | MK0149 | 353,432 | 48.42 |
| Detection Reagent Buffer | CS0333 | MK0151 | 727,712 | 37.55 |
| Detection Reagent Buffer | CS0333 | MK0152 | 49,798 | 56.77 |
| Detection Reagent Buffer | CS0333 | MK0153 | 822,270 | 21.98 |
| Detection Reagent Buffer | CS0333 | MK0154 | 409,320 | 230.5 |
| Detection Reagent Buffer | CS0333 | MK0155 | 301,956 | 126.1 |
| Detection Reagent Buffer | CS0333 | MK0156 | 174,991 | 115.7 |
| Detection Reagent Buffer | CS0333 | MK0157 | 515,775 | 18.73 |
| Detection Reagent Buffer | CS0333 | MK0158 | 524,381 | 20.76 |

TABLE 13-continued

Reagent compositions included 0.005 mg/ml luciferase enzyme variant + 2 mM ATP, and 200 fM to 2 mM substrate in Detection Reagent buffer. The composition was incubated for 3 mins and read on GloMax ® Multi + platform.

| Buffer | Substrate | Enzyme | Vmax (RLU) | Km (uM) |
|---|---|---|---|---|
| Detection Reagent Buffer | CS0333 | MK0159 | 523,610 | 20.93 |
| Detection Reagent Buffer | CS0333 | MK0145 | 591,292 | 21.46 |
| Detection Reagent Buffer | CS0280 | ATG4254 | 22,339 | 858.7 |
| Detection Reagent Buffer | CS0280 | MK0137 | 88,972 | 534.6 |
| Detection Reagent Buffer | CS0280 | MK0148 | 26,247 | 619.4 |
| Detection Reagent Buffer | CS0280 | MK0149 | 44,058 | 678.1 |
| Detection Reagent Buffer | CS0280 | MK0151 | 58,187 | 632.3 |
| Detection Reagent Buffer | CS0280 | MK0152 | 10,047 | 847.9 |
| Detection Reagent Buffer | CS0280 | MK0153 | 88,269 | 474 |
| Detection Reagent Buffer | CS0280 | MK0154 | 24,533 | 954.4 |
| Detection Reagent Buffer | CS0280 | MK0155 | 32,480 | 798 |
| Detection Reagent Buffer | CS0280 | MK0156 | 21,620 | 1206 |
| Detection Reagent Buffer | CS0280 | MK0157 | 87,011 | 630.9 |
| Detection Reagent Buffer | CS0280 | MK0158 | 39,068 | 567.8 |
| Detection Reagent Buffer | CS0280 | MK0159 | 40,925 | 601.5 |
| Detection Reagent Buffer | CS0280 | MK0145 | 38,794 | 391.2 |

TABLE 14

Reagent compositions included 0.005 mg/ml luciferase enzyme variant + 2 mM ATP, and 200 fM to 2 mM substrate in Bright-Glo ™ buffer. The composition was incubated for 3 mins and read on GloMax ® Multi + platform.

| Buffer | Substrate | Enzyme | Vmax (RLU) | Km (uM) |
|---|---|---|---|---|
| BrightGlo Suffer | D/L-luciferin | Ppe variant | 14,958,892 | 1.035 |
| BrightGlo Buffer | D/L-luciferin | ATG4254 | 888,935 | 0.343 |
| BrightGlo Buffer | D/L-luciferin | MK0137 | 253,978 | 0.08346 |
| BrightGlo Buffer | D/L-luciferin | MK0148 | 1,993,509 | 0.07367 |
| BrightGlo Buffer | D/L-luciferin | MK0149 | 351,895 | 0.04824 |
| BrightGlo Buffer | D/L-luciferin | MK0151 | 924,955 | 0.08341 |
| BrightGlo Buffer | D/L-luciferin | MK0152 | 1,055,203 | 0.05832 |
| BrightGlo Buffer | D/L-luciferin | MK0153 | 1,081,804 | 0.1761 |
| BrightGlo Buffer | D/L-luciferin | MK0154 | 2,997,269 | 0.1078 |
| BrightGlo Buffer | D/L-luciferin | MK0155 | 550,291 | 0.0804 |
| BrightGlo Buffer | D/L-luciferin | MK0156 | 1,244,361 | 0.0613 |
| BrightGlo Buffer | D/L-luciferin | MK0157 | 590,903 | 0.1003 |
| BrightGlo Buffer | D/L-luciferin | MK0158 | 2,509,334 | 0.1092 |

TABLE 14-continued

Reagent compositions included 0.005 mg/ml luciferase enzyme variant + 2 mM ATP, and 200 fM to 2 mM substrate in Bright-Glo ™ buffer. The composition was incubated for 3 mins and read on GloMax ® Multi + platform.

| Buffer | Substrate | Enzyme | Vmax (RLU) | Km (uM) |
|---|---|---|---|---|
| BrightGlo Buffer | D/L-luciferin | MK0159 | 2,363,790 | 0.1068 |
| BrightGlo Buffer | D/L-luciferin | MK0145 | 334,536 | 0.1362 |
| BrightGlo Buffer | CS0333 | ATG4254 | 3,833,186 | 20.11 |
| BrightGlo Buffer | CS0333 | MK0137 | 3,236,246 | 4.271 |
| BrightGlo Buffer | CS0333 | MK0148 | 2,895,248 | 8.435 |
| BrightGlo Buffer | CS0333 | MK0149 | 1,336,251 | 4.888 |
| BrightGlo Buffer | CS0333 | MK0151 | 4,586,290 | 6.45 |
| BrightGlo Buffer | CS0333 | MK0152 | 519,457 | 4.089 |
| BrightGlo Buffer | CS0333 | MK0153 | 4,114,986 | 6.658 |
| BrightGlo Buffer | CS0333 | MK0154 | 1,706,369 | 10.61 |
| BrightGlo Buffer | CS0333 | MK0155 | 1,487,388 | 7.879 |
| BrightGlo Buffer | CS0333 | MK0156 | 793,473 | 7.156 |
| BrightGlo Buffer | CS0333 | MK0157 | 2,835,770 | 4.509 |
| BrightGlo Buffer | CS0333 | MK0158 | 1,546,728 | 14.64 |
| BrightGlo Buffer | CS0333 | MK0159 | 1,528,708 | 14.68 |
| BrightGlo Buffer | CS0333 | MK0145 | 2,891,897 | 6.83 |
| BrightGlo Buffer | CS0280 | ATG4254 | 177,450 | 32.73 |
| BrightGlo Buffer | CS0280 | MK0137 | 825,876 | 4.082 |
| BrightGlo Buffer | CS0280 | MK0148 | 359,383 | 8.939 |
| BrightGlo Buffer | CS0280 | MK0149 | 652,464 | 5.601 |
| BrightGlo Buffer | CS0280 | MK0151 | 534,004 | 4.879 |
| BrightGlo Buffer | CS0280 | MK0152 | 330,383 | 5.74 |
| BrightGlo Buffer | CS0280 | MK0153 | 1,098,792 | 7.707 |
| BrightGlo Buffer | CS0280 | MK0154 | 449,576 | 41.73 |
| BrightGlo Buffer | CS0280 | MK0155 | 570,972 | 8.071 |
| BrightGlo Buffer | CS0280 | MK0156 | 378,264 | 9.119 |
| BrightGlo Buffer | CS0280 | MK0157 | 951,258 | 4.487 |
| BrightGlo Buffer | CS0280 | MK0158 | 426,927 | 2.944 |
| BrightGlo Buffer | CS0280 | MK0159 | 439,625 | 2.781 |
| BrightGlo Buffer | CS0280 | MK0145 | 368,599 | 5.72 |

It is understood that the foregoing detailed description and accompanying examples are merely illustrative and are not to be taken as limitations upon the scope of the disclosure, which is defined solely by the appended claims and their equivalents.

Various changes and modifications to the disclosed embodiments will be apparent to those skilled in the art. Such changes and modifications, including without limitation those relating to the chemical structures, substituents, derivatives, intermediates, syntheses, compositions, formulations, or methods of use of the disclosure, may be made without departing from the spirit and scope thereof

SEQUENCE LISTING (248 sequences)

SEQ ID NO: 1 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVASIMFSSGTTGLPKGVMLTHKNIVARFSIAKDPTFGNAINPTSAILTVIPFHHGFGMMTTLGYFTCGFRVVLMHTFEEKLFLQSLQDYKVESTLLVPTLMAFLAKSALCEKYDLSHLKEIASGGAPLSKEIGEMVKKRFKLNFVRQGYGLTETTSAVLITPKGDAKPGSTGKIVPLHAVKVVDPTTGKILGPNEPGELYFKGPMIMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 2 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRVVLMHTFEEKLFLQSLQDYKVESTLLVPTLMAFLAKSALVEKYDFPHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 3 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVASIMFSSGTTGLPKGVMLTHKNIVARFSIAKDPTFGNAINPTSAILTVLPFHHGFGMMTTLGSFTCGFRVVLMHTFEEKLFLQSLQDYKVESTLLVPTLMAFLAKSALVEKYDLSHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 4 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVASIMFSSGTTGLPKGVMLTHKNIVARFSIAKDPTFGNAINPTSAILTVIPFHRGFGMMTTLGYFTCGFRVVLMHTFEEKLFLQSLQDYKVESTLLVPTLMAFLAKSALGEKYDLSHLKEIASGGAPLSKEIGEMVKKRFKLNFVRQGYGLTETTSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 5 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVASIMFSSGTTGLPKGVMLTHKNIVARFSIAKDPTFGNAINPTSAILTVIPFHWGFGMMTTLGYFTCGFRVVLMHTFEEKLFLQSLQDYKVESTLLVPTLMAFLAKSALVEKYDLSHLKEIASGGAPLSKEIGEMVKKRFKLNFVRQGYGLTETTSAVLITPKGDAKPGSTGKIVPLHAVKVVDPTTGKILGPNEPGELYFKGPMIMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 6 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVASIMFSSGTTGLPKGVMLTHKNIVARFSIAKDPTFGNAINPTSAILTVIPFHWGFGMMTTLGSFTCGFRVVLMHTFEEKLFLQSLQDYKVESTLLVPTLMAFLAKSALVEKYDLSHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 7 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVASIMFSSGTTGLPKGVMLTHKNIVARFSIAKDPTFGNAINPTSAILTVIPFHWGFGMMTTLGSFTCGFRVVLMHTFEEKLFLQSLQDYKVESTLLVPTLMAFLAKSALVEKYDLSHLKEIASGGAPLSKEIGEMVKKRFKLNFVRQGYGLTETTSAVLITPKGDAKPGSTGKIVPLHAVKVVDPTTGKILGPNEPGELYFKGPMIMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 8 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVASIMFSSGTTGLPKGVMLTHKNIVARFSIAKDPTFGNAINPTSAILTVIPFHWGFGMMTTLGYFTCGFRVVLMHTFEEKLFLQSLQDYKVESTLLVPTLMAFLAKSALVEKYDLSHLKEIASGGAPLSKEIGEMVKKRFKLNFVRQGYGLTEATSAVLITPKGDAKPGSTGKIVPLHAVKVVDPTTGKILGPNEPGELYFKGPMIMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 9 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVASIMFSSGTTGLPKGVMLTHKNIVARFSIAKDPTFGNAINPTSAILTVIPFHWGFGMMTTLGYFTCGFRVVLMHTFEEKLFLQSLQDYKVESTLLVPTLMAFLAKSALVEKYDLSHLKEIASGGAPLSKEIGEMVKKRFKLNFVRQGYGLTETTSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 10 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVASIMFSSGTTGLPKGVMLTHKNIVARFSIAKDPTFGNAINPTSAILTVIPFHWGFGMMTTLGSFTCGFRVVLMHTFEEKLFLQSLQDYKVESTLLVPTLMAFLAKSALVEKYDLSHLKEIASGGAPLSKEIGEMVKKRFKLNFVRQGYGLTEATSAVLITPKGDAKPGSTGKIVPLHAVKVVDPTTGKILGPNEPGELYFKGPMIMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 11 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVASIMFSSGTTGLPKGVMLTHKNIVARFSIAKDPTFGNAINPTSAILTVIPFHWGFGMMTTLGSFTCGFRVVLMHTFEEKLFLQSLQDYKVESTLLVPTLMAFLAKSALVEKYDLSHLKEIASGGAPLSKEIGEMVKKRFKLNFVRQGYGLTETTSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 12 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVASIMFSSGTTGLPKGVMLTHKNIVARFSIAKDPTFGNAINPTSAILTVIPFHWGFGMMTTLGYFTCGFRVVLMHTFEEKLFLQSLQDYKVESTLLVPTLMAFLAKSALVEKYDLSHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 13 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVASIMFSSGTTGLPKGVMLTHKNIVARFSIAKDPTFGNAINPTSAILTVLPFHWGFGMMTTLGSFTCGFRVVLMHTFEEKLFLQSLQDYKVESTLLVPTLMAFLAKSALVEKYDLSHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 14 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVASIMFSSGTTGLPKGVMLTHKNIVARFSIAKDPTFGNAINPTSAILTVIPFHWGFGMMTTLGYFTCGFRVVLMHTFEEKLFLQSLQDYKVESTLLVPTLMAFLAKSALGEKYDLSHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 15 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVASIMFSSGTTGLPKGVMLTHKNIVARFSIAKDPTFGNAINPTSAILTVIPFHWGFGMMTTLGYFTCGFRVVLMHTFEEKLFLQSLQDYKVESTLLVPTLMAFLAKSALGEKYDFSHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 16 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVASIMFSSGTTGLPKGVMLTHKNIVARFSIAKDPTFGNAINPTSAILTVIPFHWGFGMMTTLGYFTCGFRVVLMHTFEEKLFLQSLQDYKVESTLLVPTLMAFLAKSALGEKYDLPHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 17 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVASIMFSSGTTGLPKGVMLTHKNIVARFSIAKDPTFGNAINPTSAILTVIPFHWGFGMMTTLGYFTCGFRVVLMHTFEEKLFLQSLQDYKVESTLLVPTLMAFLAKSALGEKYDFPHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 18 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVASIMFSSGTTGLPKGVMLTHKNIVARFSIAKDPTFGNAINPTSAILTVIPFHWGFGMMTTLGYFTCGFRVVLMHTFEEKLFLQSLQDYKVESTLLVPTLMAFLAKSALVEKYDFPHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 19 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRVVLMHTFEEKLFLQSLQDYKVESTLLVPTLMAFLAKSALVEKYDFSHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 20 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVASIMFSSGTTGLPKGVMLTHKNIVARFSIAKDPTFGDAINPTSAILTVIPFHWGFGMMTTLGYFTCGFRVVLMHTFEEKLFLQSLQDYKVESTLLIPTLMAFLAKSALVEKYDLSHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 21 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVASIMFSSGTTGLPKGVMLTHKNIVARFSIAKDPTFGDAINPTSAILTVIPFHWGFGMMTTLGYFTCGFRVVLMHTFEEKLFLQSLQDYKVESTLLVPTLMAFLAKSALGEKYDFSHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 22 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVASIMFSSGTTGLPKGVMLTHKNLVARFSIAKDPTFGNAINPTSAILTVIPFHWGFGMMTTLGYFTCGFRVALMHTFEEKLFLQSLQDYKVESTLLVPTLMAFLAKSALVEKYDFSHLKEIASGGAPLSKEIGEMVKKRFKLNFGRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 23 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVASIMFSSGTTGLPKGVMLTHKNIVARFSIAKDPTFGDAINPTSAILTVIPFHWGFGMMTTLGYFTCGFRVVLMHTFEEKLFLQSLQDYKVESTLLVPTLMAFLAKSALVEKYDFSHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 24 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARLSIAKDPTFGDAINPTTAILTVIPFHWGFGMMTTLGYFTCGFRVALMHTFEEKLFLQSLQDYKVESTLLVPTLMAFHAKSALVEKYDFPHLEEIASGGSPLSKEIGEMVKKRFKLNFGRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKMLRQMLEKHTNGHHHHHHHH

SEQ ID NO: 25 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRVVLMHTFEEKLFLQSLQDYKVESTLLVPTLMAFLAKSALVEKYDFPHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 26 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYVERELIHSLGIVKPRIVFCSKNTFQKVLNVKSKLKSIETIIILDLNEDLGGYQCLNNFISQNSDSNLDVKKFKPYSFNRDDQVASIMFSSGTTGLPKGVMLTHKNIVARFSIAKDPTFGNAINPTSAILTVIPFHWGFGMMTTLGYFTCGFRVALMHTFEEKLFLQSLQDYKVESTLLVPTLMAFLAKSALVEKYDFPHLKEIASGGAPLSKEIGEMVKKRFKLNFGRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKMLRQMLEKHTNGHHHHHHHH

SEQ ID NO: 27 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFHKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRVVLMHTFEEKLFLQSLQDYKVESTLLVPTLMAFLAKSALVEKYDFPHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 28 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNLVARFSIAKDPTFGDAINPTSAILTVIPFHWGFGMMTTLGYFTCGFRVVLMHTFEEKLFLQSLQDYKVESTLLVPTLMAFLAKSALVEKYDFPHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 29 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARLSIAKDPTFGDAINPTSAILTVIPFHWGFGMMTTLGYFTCGFRVVLMHTFEEKLFLQSLQDYKVESTLLVPTLMAFLAKSALVEKYDFPHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 30 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPSSAILTVIPFHWGFGMMTTLGYFTCGFRVVLMHTFEEKLFLQSLQDYKVESTLLVPTLMAFLAKSALVEKYDFPHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 31 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTTAILTVIPFHWGFGMMTTLGYFTCGFRVVLMHTFEEKLFLQSLQDYKVESTLLVPTLMAFLAKSALVEKYDFPHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 32 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAVLTVIPFHWGFGMMTTLGYFTCGFRVVLMHTFEEKLFLQSLQDYKVESTLLVPTLMAFLAKSALVEKYDFPHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 33 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRVALMHTFEEKLFLQSLQDYKVESTLLVPTLMAFLAKSALVEKYDFPHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 34 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRVVLMHTFEEKLFLQSLQDYKVESTLLVPTLMAFLAKSALVEKYDFPHLKEIASGGAPLSKEIGEMVKKRFKLNFGRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 35 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRVVLMHTFEEKLFLQSLQDYKVESTLLVPTLMAFLAKSALVEKYDFPHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVARQVSTAKWLRGGVKFLDEIPKGSTGKIDRKVLRQMLEKHTNGHHHHHHHH

SEQ ID NO: 36 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNLVARLSIAKDPTFGDAINPTSAILTVIPFHWGFGMMTTLGYFTCGFRVVLMHTFEEKLFLQSLQDYKVESTLLVPTLMAFLAKSALVEKYDFPHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 37 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPSTAILTVIPFHWGFGMMTTLGYFTCGFRVVLMHTFEEKLFLQSLQDYKVESTLLVPTLMAFLAKSALVEKYDFPHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 38 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTTAVLTVIPFHWGFGMMTTLGYFTCGFRVVLMHTFEEKLFLQSLQDYKVESTLLVPTLMAFLAKSALVEKYDFPHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 39 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPSSAVLTVIPFHWGFGMMTTLGYFTCGFRVVLMHTFEEKLFLQSLQDYKVESTLLVPTLMAFLAKSALVEKYDFPHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 40 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAFNPTSAILTVIPFHWGFGMMTTLGYFTCGFRVVLMHTFEEKLFLQSLQDYKVESTLLVPTLMAFLAKSALVEKYDFPHLKEIASGGAPLSKEIGEMVKKRFKLNFGRQGYGLTEATSAVLITPKGDAKPGSTGKIVPLHAVKVVDPTTGKILGPNEPGELYFKGPMKMKGYYNNEEATKAMIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 41 - protein, 552 aa, Artificial Sequence
  Variant of Photuris pennsylvanica
MADKNILYGPEPFYPLEDGTAGEQMFDALSRYAAIPGRIALTNAHTKENVLYEEFLKLSCRLAESFKKYGLKQNDTIAVCSENSLQFFLPVIASLYLGIIVAPVNDKFVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRVVLMHTFEEKLFLQSLQDYKVESTLLVPTLMAFLAKSALVEKYDFPHLKEIASGGAPLSKEIGEMVKKRFKLNFVRQGYGLTEATSAVLITPKGDAKPGSTGKIVPLHAVKVVDPITGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 42 - protein, 552 aa, Artificial Sequence
  Variant of Photuris pennsylvanica
MADKNILYGPEPFYPLEDGTAGEQMFDALSRYAAIPGRIALTNAHTKENVLYEEILKLSCRLAESFKKYGLKQNDTIAVCSENSLQFFLPVIASLYLGIIVAPVNDKYVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRVALMHTFEEKLFLQSLQDYKVESTLLVPTLMAFLAKSALVEKYDFPHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDVAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 43 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKFVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRAVLMHTFEEKLFLQSLQDYKVESTLLVPTLMAFLAKSALVEKYDFPHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDDDGHVYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 44 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAFNPTSAILTVIPFHWGFGMMTTLGYFTCGFRVVLMHTFEEKLFLQSLQDYKVESTLLVPTLMAFLAKSALVEKYDFPHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 45 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRVVLMHTFEEKLFLQSLQDYKVESTLLVPTLMAFLAKSALVEKYDFPHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVRTGKYLNEQIVQDYVASQVSTAKWLRGGVKFLDEIPKGSTGKIDRKVLRQMLEKHTNGHHHHHHHH

SEQ ID NO: 46 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYVERELIHSLGIVKPRIVFCSKNTFQKVLNVKSKLKSIETIIILDLSEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRAVLMHTFEEKLFLQSLQDYKVESTLLVPTLMAFLAKSALVEKYDFPHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAMIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 47 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYVERELIHSLGIVKPRIVFCSKNTFQKVLNVKSKLKSIETIIILDLNEDLGGYQCLNNFISQNSDSNLDVKKFKPCSFNRDDQVAAIMFSSGTTGLPKGVMLTHKNIVARFSIAKDPTFGDAINPTSAILTVIPFHWGFGMMTTLGYFTCGFRAVLMHTFEEKLFLQSLQDYKVESTLLVPSLMAFLAKSALVEKYDFPHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 48 - protein, 552 aa, Artificial Sequence
  Variant of Photuris pennsylvanica
MADKNILYGPEPFYPLEDGTAGEQMFDALSRCAAIPGCIALTNAHTKENVLYEEFLKLSCRLAESFKKYGLKQNDTIAVCSENSLQFFLPVIASLYLGIIVAPVNDKYVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRVVLMHTFEEKLFLQSLQDYKVESTLLVPTLMAFLAKSALVEKYDFPHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 49 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGYGMMTTLGYFTCGFRAVLMHTFEEKLFLQSLQDYKVESTLLVPTLMAFLAKSALVEKYDFPHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 50 - protein, 552 aa, Artificial Sequence; identical to SEQ ID NO: 44
  Variant of Photuris pennsylvanica

SEQ ID NO: 51 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYVERELIHSLGIVQPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGYGMMTTLGYFTCGFRAVLMHTFEEKLFLQSLQDYKVESTLLVPTLMAFLAKSALVEKYDFPHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 52 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYVERELIHSLGIVQPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRAVLMHTFEEKLFLQSLQDYKVESTLLIPTLMAFLAKSALVEKYDFPHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 53 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDQYIERELIHSLGIVKPRIVFCSKNTFQKVLNVKSKLKSIETIIILDLNEDLGGYQCLNNFISQNSDSNLDVKKFKPYSFNRDDQVATIMFSSGTTGLPKGVMLTHKNIVARFSIAKDPTFGNAINPTSAILTVIPFHWGFGMMTTLGYFTCGFRVALMHTFEEKLFLQSLQDYKVESTLLVPTLMAFLAKSALVEKYDLSHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 54 - protein, 552 aa, Artificial Sequence; identical to SEQ ID NO: 20
  Variant of Photuris pennsylvanica

SEQ ID NO: 55 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYMERELIHSLGIVKPRIVFCSKNTFQKVLNVKSKLKSIETIIILDLNEDLGGYQCLNNFISQNSDSNLDVKKFKPYSFNRDDQVALIMFSSGTTGLPKGVMLTHKNIVARFSIAKDPTFGNAINPTSAILTVIPFHWGFGMMTTLGYFTCGFRVVLMHTFEEKLFLQSLQDYKVESTLLVPTLMAFLAKSALVEKYDLSHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 56 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYMERELIHSLGIVKPRIVFCSKNTFQKVLNVKSKLKSIETIIILDLNEDLGGYQCLNNFISQNSDSNLDVKKFKPYSFNRDDQVALIMFSSGTTGLPKGVMLTHKNIVARFSIAKDPTFGNAINPTSAILTVIPFHWGFGMMTTLGYFTCGFRVVLMHTFEEKLFLQSLQDYKVESTLLVPTLMAFHAKSALVEKYDLSHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 57 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDQYIERELIHSLGIVKPRIVFCSKNTFQKVLNVKSKLKSIETIIILDLNEDLGGYQCLNNFISQNSDSNLDVKKFKPYSFNRDDQVASIMFSSGTTGLPKGVMLTHKNIVARFSIAKDPTFGNAINPTSAILTVIPFHWGFGMMTTLGYFTCGFRVVLMHTFEEKLFLQSLQDYKVESTLLVPTLMAFLAKSALVEKYDFSHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 58 - protein, 552 aa, Artificial Sequence; identical to SEQ ID NO: 57
  Variant of Photuris pennsylvanica

SEQ ID NO: 59 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDQYIERELIHSLGIVKPRIVFCSKNTFQKVLNVKSKLKSIETIIILDLNEDLGGYQCLNNFISQNSDSNLDVKKFKPYSFNRDDQVATIMFSSGTTGLPKGVMLTHKNIVARFSIAKDPTFGNAINPTSAILTVIPFHWGFGMMTTLGYFTCGFRVVLMHTFEEKLFLQSLQDYKVESTLLVPTLMAFLAKSALVEKYDLSHLKEIASGGSPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 60 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYVERELIHSLGIVKPRIVFCSKNTFQKVLNVKSKLKSIETIIILDLNEDLGGYQCLNNFISQNSDSNLDVKKFKPYSFNRDDQVASIMFSSGTTGLPKGVMLTHKNIVARFSIAKDPTFGNAINPTSAILTVIPFHWGFGMMTTLGYFTCGFRVALMHTFEEKLFLQSLQDYKVESTLLIPTLMAFLAKSALVEKYDLSHLNEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 61 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVAPIMFSSGTTGLPKGVMLTHKNIVARFSIAKDPTFGNAINPTSAILTVIPFHWGFGMMTTLGYFTCGFRVVLMHTFEEKLFLQSLQDYKVESTLLVPTLMAFLAKSALVEKYDLSHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 62 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYMERELIHSLGIVKPRIVFCSKNTFQKVLNVKSKLKSIETIIILDLNEDLGGYQCLNNFISQNSDSNLDVKKFKPYSFNRDDQVASIMFSSGTTGLPKGVMLTHKNIVARFSIAKDPTFGNAINPTSAILTVIPFHWGFGMMTTLGYFTCGFRVVLMHTFEEKLFLQSLQDYKVESTLLVPTLMAFLAKSALVEKYDLSHLKEIASGGSPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 63 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVNPRIVFCSKNTFQKVLNVKSKLKSIETIIILDLNEDLGGYQCLNNFISQNSDSNLDVKKFKPYSFNRDDQVASIMFSSGTTGLPKGVMLTHKNIVARFSIAKDPTFGDAINPTSAILTVIPFHWGFGMMTTLGYFTCGFRVVLMHTFEEKLFLQSLQDYKVESTLLIPTLMAFLAKSALVEKYDLSHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 64 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKFIERELIHSLGIVKPRIVFCSKNTFQKVLNVKSKLKSIETIIILDLNEDLGGYQCLNNFISQNSDSNLDVKKFKPYSFNRDDQVASIMFSSGTTGLPKGVMLTHKNIVARFSIAKDPTFGNAINPTSAILTVIPFHWGFGMMTTLGYFTCGFRVALMHTFEEKLFLQSLQDYKVESTLLVPTLMAFLAKSALVEKYDFSHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 65 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVASIMFSSGTTGLPKGVMLTHKNIVARFSIAKDPTFGNAINPTSAILTVIPFHWGFGMMTTLGYFTCGFRVVLMHTFEEKLFLQSLQDYKVESTLLVPTLMAFLAKSALVEKYDLPHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 66 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDQYIERELIHSLGIVKPRIVFCSKNTFQKVLNVKSKLKSIETIIILDLNEDLGGYQCLNNFISQNSDSNLDVKKFKPYSFNRDDQVASIMFSSGTTGLPKGVMLTHKNIVARFSIAKDPTFGDAINPTSAILTVIPFHWGFGMMTTLGYFTCGFRVVLMHTFEEKLFLQSLQDYKVESTLLVPTLMAFLAKSALVEKYDLSHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 67 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVASIMFSSGTTGLPKGVMLTHKNIVARFSIAKDPTFGNAINPTSAVLTVIPFHWGFGMMTTLGYFTCGFRVVLMHTFEEKLFLQSLQDYKVESTLLVPTLMAFLAKSALVEKYDLSHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 68 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYVERELIHSLGIVKPRIVFCSKNTFQKVLNVKSKLKSIETIIILDLNEDLGGYQCLNNFISQNSDSNLDVKKFKPYSFNRDDQVASIMFSSGTTGLPKGVMLTHKNIVARFSIAKDPTFGNAINPTSAILTVIPFHHGFGMMTTLGYFTCGFRVVLMHTFEEKLFLQSLQDYKVESTLLVPTLMAFLAKSALVEKYDLSHLKEIASGGAPLSKEIGEMVKKRFKLNFVRQGYGLTETTSAVLITPKGDAKPGSTGKIVPLHAVKVVDPTTGKILGPNEPGELYFKGPMIMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 69 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGNAINPTSAILTVIPFHHGFGMMTTLGYFTCGFRVVLMHTFEEKLFLQSLQDYKVESTLLVPTLMAFLAKSALVEKYDLSHLKEIASGGAPLSKEIGEMVKKRFKLNFVRQGYGLTETTSAVLITPKGDAKPGSTGKIVPLHAVKVVDPTTGKILGPNEPGELYFKGPMIMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 70 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVASIMFSSGTTGLPKGVMLTHKNIVARFSIAKDPTFGNAINPTSAILTVIPFHWGFGMMTTLGYFTCGFRVVLMHTFEEKLFLQSLQDYKVESTLLVPTLMAFLAKSALVEKYDFSHLKEIASGGAPLSKEIGEMVKKRFKLNFVRQGYGLTETTSAVLITPKGDAKPGSTGKIVPLHAVKVVDPTTGKILGPNEPGELYFKGPMIMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 71 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVASIMFSSGTTGLPKGVMLTHKNIVARFSIAKDPTFGNAINPTSAILTVIPFHHGFGMMTTLGYFTCGFRVVLMHTFEEKLFLQSLQDYKVESTLLVPTLMAFLAKSALVEKYDLPHLKEIASGGAPLSKEIGEMVKKRFKLNFVRQGYGLTETTSAVLITPKGDAKPGSTGKIVPLHAVKVVDPTTGKILGPNEPGELYFKGPMIMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 72 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVASIMFSSGTTGLPKGVMLTHKNIVARFSIAKDPTFGNAINPTSAILTVIPFHHGFGMMTTLGYFTCGFRVVLMHTFEEKLFLQSLQDYKVESTLLVPTLMAFLAKSALVEKYDLSHLKEIASGGAPLSKEIGEMVKKRFKLNFVRQGYGLTETTSAVLITPKGDAKPGSTGKIVPLHAVKVVDPTTGKILGPNEPGELYFKGPMIMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 73 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVASIMFSSGTTGLPKGVMLTHKNIVARFSIAKDPTFGNAINPTSAILTVIPFHHGFGMMTTLGYFTCGFRVVLMHTFEEKLFLQSLQDYKVESTLLVPTLMAFLAKSALVEKYDLSHLKEIASGGAPLSKEIGEMVKKRFKLNFVRQGYGLTEATSAVLITPKGDAKPGSTGKIVPLHAVKVVDPTTGKILGPNEPGELYFKGPMIMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 74 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVASIMFSSGTTGLPKGVMLTHKNIVARFSIAKDPTFGNAINPTSAILTVIPFHHGFGMMTTLGYFTCGFRVVLMHTFEEKLFLQSLQDYKVESTLLVPTLMAFLAKSALVEKYDLSHLKEIASGGAPLSKEIGEMVKKRFKLNFVRQGYGLTETTSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 75 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVASIMFSSGTTGLPKGVMLTHKNIVARFSIAKDPTFGNAINPTSAILTVIPFHHGFGMMTTLGYFTCGFRVVLMHTFEEKLFLQSLQDYKVESTLLVPTLMAFLAKSALVEKYDLSHLKEIASGGAPLSKEIGEMVKKRFKLNFVRQGYGLTETTSAVLITPKGDAKPGSTGKIVPLHAVKVVDPTTGKILGPNEPGELYFKGPMLMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 76 - protein, 552 aa, Artificial Sequence; identical to SEQ ID NO: 25
  Variant of Photuris pennsylvanica

SEQ ID NO: 77 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYVERELIHSLGIVKPRIVFCSKNTFQKVLNVKSKLKSIETIIILDLNEDLGGYQCLNNFISQNSDSNLDVKKFKPYSFNRDDQVASIMFSSGTTGLPKGVMLTHKNIVARFSIAKDPTFGDAINPTSAILTVIPFHWGFGMMTTLGYFTCGFRVVLMHTFEEKLFLQSLQDYKVESTLLVPTLMAFLAKSALVEKYDFPHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 78 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHHGFGMMTTLGYFTCGFRVVLMHTFEEKLFLQSLQDYKVESTLLVPTLMAFLAKSALVEKYDFPHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 79 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRVVLMHTFEEKLFLQSLQDYKVESTLLVPTLMAFLAKSALVEKYDLPHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 80 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRVVLMHTFEEKLFLQSLQDYKVESTLLVPTLMAFLAKSALVEKYDFSHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 81 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRVVLMHTFEEKLFLQSLQDYKVESTLLVPTLMAFLAKSALVEKYDFPHLKEIASGGAPLSKEIGEMVKKRFKLNFVRQGYGLTETTSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 82 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRVVLMHTFEEKLFLQSLQDYKVESTLLVPTLMAFLAKSALVEKYDFPHLKEIASGGAPLSKEIGEMVKKRFKLNFVRQGYGLTEATSAVLITPKGDAKPGSTGKIVPLHAVKVVDPTTGKILGPNEPGELYFKGPMIMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 83 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGNAINPTSAILTVIPFHWGFGMMTTLGYFTCGFRVVLMHTFEEKLFLQSLQDYKVESTLLVPTLMAFLAKSALVEKYDFPHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 84 - protein, 552 aa, Artificial Sequence; identical to SEQ ID NO: 2
  Variant of Photuris pennsylvanica

SEQ ID NO: 85 - protein, 552 aa, Artificial Sequence; identical to SEQ ID NO: 2
  Variant of Photuris pennsylvanica

SEQ ID NO: 86 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRVVLMHTFEEKLFLQSLQDYKVESTLLVPTLMAFLAKSALVEKYDFPHLKEIASGGAPLSKEIGEMVKKRFKLNFVRQGYGLTEATSAILITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 87 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRVVLMHTFEEKLFLQSLQDYKVESTLLVPTLMAFLAKSALVEKYDFPHLKEIASGGMPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 88 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRVVLMHTFEEKLFLQSLQDYKVESTLLVPTLMAFLAKSALVEKYDFPHLKEIASGGWPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 89 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRVVLMHTFEEKLFLQSLQDYKVESTLLVPTLMAFLAKSALVEKYDFPHLKEIASGGAPLSKEIGEMVKKRFKLNFVRQGMGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 90 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRVVLMHTFEEKLFLQSLQDYKVESTLLVPTLMAFLAKSALVEKYDFPHLKEIASGGAPLSKEIGEMVKKRFKLNFVRQGYGLSEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 91 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRVVLMHTFEEKLFLQSLQDYKVESTLLVPTLMAFLAKSALVEKYDFPHLKEIASGGAPLSKEIGEMVKKRFKLNFVRQGYGLTEITSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 92 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRVVLMHTFEEKLFLQSLQDYKVESTLLVPTLMAFLAKSALVEKYDFPHLKEIASGGWPLSKEIGEMVKKRFKLNFVRQGYGLTEITSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 93 - protein, 552 aa, Artificial Sequence
  Variant of Photuris pennsylvanica
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDNYVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRVVLMHTFEEKLFLQSLQDYKVESTLLVPSLMAFLAKSALVEKYDFPHLKEIASGGAPLSKEIGEMVKKRFKLNFVRQGYGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 94 - protein, 552 aa, Artificial Sequence; identical to SEQ ID NO: 52
  Variant of Photuris pennsylvanica

SEQ ID NO: 95 - protein, 552 aa, Artificial Sequence
  Variant of Photuris pennsylvanica
MADKNILYGPEPFYPLEDGTAGEQMFDALSRYAAIPGRIALTNAHTKENVLYEEFLKLSCRLAESFKKYGLKQNDTIAVCSENSLQFFLPVIASLYLGIIVAPVNDKYVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRVVLMHTFEEKLFLQSLQDYKVESTLLVPTLMAFLAKSALVEKYDFPHLKEIASGGWPLSKEIGEMVKKRFKLNFVRQGYGLSEATSAILITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 96 - protein, 552 aa, Artificial Sequence
  Variant of Photuris pennsylvanica
MADKNILYGPEPFYPLEDGTAGEQMFDALSRYAAIPGRIALTNAHTKENVLYEEILKLSCRLAESFKKYGLKQNDTIAVCSENSLQFFLPVIASLYLGIIVAPVNDKYVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRVVLMHTFEEKLFLQSLQDYKVESTLLVPTLMAFLAKSALVEKYDFPHLKEIASGGWPLSKEIGEMVKKRFKLNFVRQGYGLSETTSAILITPKGDAKPGSTGKIVPLHAVKVVDPTTGKILGPNEPGELYFKGPMIMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 97 - protein, 552 aa, Artificial Sequence
  Variant of Photuris pennsylvanica
MADKNILYGPEPFYPLEDGTAGEQMFDALSRYAAIPGRIALTNAHTKENVLYEEFLKLSCRLAESFKKYGLKQNDTIAVCSENSLQFFLPVIASLYLGIIVAPVNDKYVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPNGVMLTHKNIVARFSIAKDPTFGDAINPTSAILTVIPFHWGFGMMTTLGYFTCGFRVVLMHTFEEKLFLQSLQDYKVESTLLVPTLMAFLAKSALVEKYDFPHLKEIASGGWPLSKEIGEMVKKRFKLNFVRQGYGLSEATSAILITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 98 - protein, 552 aa, Artificial Sequence
  Variant of Photuris pennsylvanica
MADKNILYGPEPFYPLEDGTAGEQMFDALSRYAAIPGRIALTNAHTKENVLYEEILKLSCRLAESFKKYGLKQNDTIAVCSENSLQFFLPVIASLYLGIIVAPVNDKYVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRVVLMHTFEEKLFLQSLQDYKVESTLLVPTLMAFLAKSALVEKYDFPHLKEIASGGWPLSKEIGEMVKKRFKLNFVRQGYGLSEATSAILITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 99 - protein, 552 aa, Artificial Sequence; identical to SEQ ID NO: 98
  Variant of Photuris pennsylvanica

SEQ ID NO: 100 - protein, 552 aa, Artificial Sequence; identical to SEQ ID NO: 98
  Variant of Photuris pennsylvanica

SEQ ID NO: 101 - protein, 552 aa, Artificial Sequence
  Variant of Photuris pennsylvanica
MADKNILYGPEPFYPLEDGTAGEQMFDALSRYAAIPGRIALTNAHTKENVLYEEILKLSCRLAESFKKYGLKQNDTIAVCSENSLQFFLPVIASLYLGIIVAPVNDKFVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRVVLMHTFEEKLFLQSLQDYKVESTLLVPTLMAFLAKSALVEKYDFPHLKEIASGGWPLSKEIGEMVKKRFKLNFVRQGMGLTEITSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 102 - protein, 552 aa, Artificial Sequence
  Variant of Photuris pennsylvanica
MADKNILYGPEPFYPLEDGTAGEQMFDALSRYAAIPGRIALTNAHTKENVLYEEILKLSCRLAESFKKYGLKQNDTIAVCSENSLQFFLPVIASLYLGIIVAPVNDKYVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRVVLMHTFEEKLFLQSLQDYKVESTLLVPTLMAFLAKSALVEKYDFPHLKEIASGGWPLSKEIGEMVKKRFKLNFVRQGYGLSEITSAILITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 103 - protein, 552 aa, Artificial Sequence
  Variant of Photuris pennsylvanica
MADKNILYGPEPFYPLEDGTAGEQMFDALSRYAAIPGRIALTNAHTKENVLYEEILKLSCRLAESFKKYGLKQNDTIAVCSENSLQFFLPVIASLYLGIIVAPVNDKFVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRVVLMHTFEEKLFLQSLQDYKVESTLLVPTLMAFLAKSALVEKYDFPHLKEIASGGWPLSKEIGEMVKKRFKLNFVRQGMGLTEATSAVLITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 104 - protein, 552 aa, Artificial Sequence
  Variant of Photuris pennsylvanica
MADKNILYGPEPFYPLEDGTAGEQMFDALSRYAAIPGRIALTNAHTKENVLYEEILKLSCRLAESFKKYGLKQNDTIAVCSENSLQFFLPVIASLYLGIIVAPVNDKFVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRVVLMHTFEEKLFLQSLQDYKVESTLLVPTLMAFLAKSALVEKYDFPHLKEIASGGWPLSKEIGEMVKKRFKLNFVRQGMGLSETTSAILITPKGDAKPGSTGKIVPLHAVKVVDPTTGKILGPNEPGELYFKGPMIMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 105 - protein, 552 aa, Artificial Sequence; identical to SEQ ID NO: 101
  Variant of Photuris pennsylvanica

SEQ ID NO: 106 - protein, 552 aa, Artificial Sequence
  Variant of Photuris pennsylvanica
MADKNILYGPEPFYPLEDGTAGEQMFDALSRYAAIPGRIALTNAHTKENVLYEEILKLSCRLAESFKKYGLKQNDTIAVCSENSLQFFLPVIASLYLGIIVAPVNDKYVERELIHSLGIVQPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRVVLMHTFEEKLFLQSLQDYKVESTLLVPTLMAFLAKSALVEKYDFPHLKEIASGGWPLSKEIGEMVKKRFKLNFVRQGMGLTEITSAILITPKGDAKPGSTGKIVPLHAVKVVDPTTGKILGPNEPGELYFKGPMKMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 107 - protein, 552 aa, Artificial Sequence
  Variant of Photuris pennsylvanica
MADKNILYGPEPFYPLEDGTAGEQMFDALSRYAAIPGRIALTNAHTKENVLYEEILKLSCRLAESFKKYGLKQNDTIAVCSENSLQFFLPVIASLYLGIIVAPVNDKFVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVVPFHWGFGMMTTLGYFTCGFRVVLMHTFEEKLFLQSLQDYKVESTLLVPTLMAFLAKSALVEKYDFPHLKEIASGGWPLSKEIGEMVKKRFKLNFVRQGMGLSETTSAILITPKGDAKPGSTGKIVPLHAVKVVDPTTGKILGPNEPGELYFKGPMIMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 108 - protein, 552 aa, Artificial Sequence
  Variant of Photuris pennsylvanica
MADKNILYGPEPFYPLEDGTAGEQMFDALSRYAAIPGRIALTNAHTKENVLYEEILKLSCRLAESFKKYGLKQNDTIAVCSENSLQFFLPVIASLYLGIIVAPVNDKFVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRVVLMHTFEEKLFLQSLQDYKVESALLVPTLMAFLAKSALVEKYDFPHLKEIASGGWPLSKEIGEMVKKRFKLNFVRQGMGLSETTSAILITPKGDAKPGSTGKIVPLHAVKVVDPTTGKILGPNEPGELYFKGPMIMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 109 - protein, 552 aa, Artificial Sequence
  Variant of Photuris pennsylvanica
MADKNILYGPEPFYPLEDGTAGEQMFDALSRYAAIPGRIALTNAHTKENVLYEEILKLSCRLAESFKKYGLKQNDTIAVCSENSLQFFLPVIASLYLGIIVAPVNDKFVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRVVLMHTFEEKLFLQSLQDYKVESTLLVPRLMAFLAKSALVEKYDFPHLKEIASGGWPLSKEIGEMVKKRFKLNFVRQGMGLSETTSAILITPKGDAKPGSTGKIVPLHAVKVVDPTTGKILGPNEPGELYFKGPMIMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 110 - protein, 552 aa, Artificial Sequence
  Variant of Photuris pennsylvanica
MADKNILYGPEPFYPLEDGTAGEQMFDALSRYAAIPGRIALTNAHTKENVLYEEILKLSCRLAESFKKYGLKQNDTIAVCSENSLQFFLPVIASLYLGIIVAPVNDKFVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRVVLMHTFEEKLFLQSLQDYKVESTLLVPTLMAFLAKSALVEKYDFPHLKEIASGGWPLSKEIGEMVKKRFKLNFVRQGMGLSETTSAILITPRGDAKPGSTGKIVPLHAVKVVDPTTGKILGPNEPGELYFKGPMIMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 111 - protein, 552 aa, Artificial Sequence
  Variant of Photuris pennsylvanica
MADKNILYGPEPFYPLEDGTAGEQMFDALSRYAAIPGRIALTNAHTKENVLYEEILKLSCRLAESFKKYGLKQNDTIAVCSENSLQFFLPVIASLYLGIIVAPVNDKFVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRVVLMHTFEEKLFLQSLQDYKVESTLLVPTLMAFLAKSALVEKYDFPHLKEIASGGWPLSKEIGEMVKKRFKLNFVRQGMGLSETTSAILITPKGDAKPGSTGKIVPLHAVKVVDPTTGKILGPNEPGELYFKGPMIMKGYYNNEEATKAIIDNDGWLRSGDIAYYDNDGHFYIVGRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 112 - protein, 552 aa, Artificial Sequence
  Variant of Photuris pennsylvanica
MADKNILYGPEPFYPLEDGTAGEQMFDALSRYAAIPGRIALTNAHTKENVLYEEILKLSCRLAESFKKYGLKQNDTIAVCSENSLQFFLPVIASLYLGIIVAPVNDKFVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRVVLMHTFEEKLFLQSLQDYKVESTLLVPTLMAFLAKSALVEKYDFPHLKEIASGGWPLSKEIGEMVKKRFKLNFVRQGMGLSETTSAILITPKGDAKPGSTGKIVPLHAVKVVDPTTGKILGPNEPGELYFKGPMIMKGYYNNEEATKAIIDNDGWLRSGDIAYYDNDGHFYIVDRRKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 113 - protein, 552 aa, Artificial Sequence
  Variant of Photuris pennsylvanica
MADKNILYGPEPFYPLEDGTAGEQMFDALSRYAAIPGRIALTNAHTKENVLYEEILKLSCRLAESFKKYGLKQNDTIAVCSENSLQFFLPVIASLYLGIIVAPVNDKFVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRVVLMHTFEEKLFLQSLQDYKVESTLLVPTLMAFLAKSALVEKYDFPHLKEIASGGWPLSKEIGEMVKKRFKLNFVRQGMGLSETTSAILITPKGDAKPGSTGKIVPLHAVKVVDPTTGKILGPNEPGELYFKGPMIMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKRLRGGVKFLDEIPKGSTGKIDRKVLRQMLEKHTNGHHHHHHHH

SEQ ID NO: 114 - protein, 552 aa, Artificial Sequence
  Variant of Photuris pennsylvanica
MADKNILYGPEPFYPLEDGTAGEQMFDALSRYAAIPGRIALTNAHTKENVLYEEILKLSCRLAESFKKYGLKQNDTIAVCSENSLQFFLPVIASLYLGIIVAPVNDKFVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRVVLMHTFEEKLFLQSLQDYKVESTLLVPTLMAFLAKSALVEKYDFPHLKEIATGGWPLSKEIGEMVKKRFKLNFVRQGMGLSETTSAILITPKGDAKPGSTGKIVPLHAVKVVDPTTGKILGPNEPGELYFKGPMIMKGYYNNEEATKAIIDNDGWLRSGDIAYYDNDGHFYIVGRRKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 115 - protein, 552 aa, Artificial Sequence
  Variant of Photuris pennsylvanica
MADKNILYGPEPFYPLEDGTAGEQMFDALSRYAAIPGRIALTNAHTKENVLYEEILKLSCRLAESFKKYGLKQNDTIAVCSENSLQFFLPVIASLYLGIIVAPVNDKFVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTRGFRVVLMHTFEEKLFLQSLQDYKVESALLVPSLMAFLAKSALVEKYDFPHLKEIASGGWPLSKEIGEMVKKRFKLNFVRQGMGLSETTSAILITPKGDAKPGSTGKIVPLHAVKVVDPTTGKILGPNEPGELYFKGPMIMKGYYNNEEATKAIIDNDGWLRSGDIAYYDNDGHFYIVDRRKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 116 - protein, 552 aa, Artificial Sequence
  Variant of Photuris pennsylvanica
MADKNILYGPEPFYPLEDGTAGEQMFDALSRYAAIPGRIALTNAHTKENVLYEEILKLSCRLAESFKKYGLKQNDTIAVCSENSLQFFLPVIASLYLGIIVAPVNDKFVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTRGFRVVLMHTFEEKLFLQSLQDYKVESTLLVPTLMAFLAKSALVEKYDFPHLKEIASGGWPLSKEIGEMVKKRFKLNFVRQGMGLSETTSAILITPRGDAKPGSTGKIVPLHAVKVVDPTTGKILGPNEPGELYFKGPMIMKGYYNNEEATKAIIDNDGWLRSGDIAYYDNDGHFYIVDRRKSLIKYKGYQVAPAEIEGILLQHPYIVDAGVTGIPDEAAGELPAAGVVVQTGKYLNEQIVQDYVASQVSTAKRLRGGVKFLDEIPKGSTGKIDRKVLRQMLEKHTNGHHHHHHHH

SEQ ID NO: 117 - protein, 552 aa, Artificial Sequence
  Variant of Photuris pennsylvanica
MADKNILYGPEPFYPLEDGTAGEQMFDALSRYAAIPGRIALTNAHTKENVLYEEILKLSCRLAESFKKYGLKQNDTIAVCSENSLQFFLPVIASLYLGIIVAPVNDKFVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRVVLMHTFEEKLFLQSLQDYKVESTLLVPSLMAFLAKSALVEKYDFPHLKEIASGGWPLSKEIGEMVKKRFKLNFVRQGMGLSETTSAILITPRGDAKPGSTGKIVPLHAVKVVDPTTGKILGPNEPGELYFKGPMIMKGYYNNEEATKAIIDNDGWLRSGDIAYYDNDGHFYIVGRLKSLIKYKGYQVAPAEIEGILLQHPYIVDAGVTGIPDEAAGELPAAGVVVQTGKYLNEQIVQDYVASQVSTAKRLRGGVKFLDEIPKGSTGKIDRKVLRQMLEKHTNGHHHHHHHH

SEQ ID NO: 118 - protein, 552 aa, Artificial Sequence
  Variant of Photuris pennsylvanica
MADKNILYGPEPFYPLEDGTAGEQMFDALSRYAAIPGRIALTNAHTKENVLYEEILKLSCRLAESFKKYGLKQNDTIAVCSENSLQFFLPVIASLYLGIIVAPVNDKFVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTRGFRVVLMHTFEEKLFLQSLQDYKVESTLLVPSLMAFLAKSALVEKYDFPHLKEIATGGWPLSKEIGEMVKKRFKLNFVRQGMGLSETTSAILITPRGDAKPGSTGKIVPLHAVKVVDPTTGKILGPNEPGELYFKGPMIMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 119 - protein, 552 aa, Artificial Sequence
  Variant of Photuris pennsylvanica
MADKNILYGPEPFYPLEDGTAGEQMFDALSRYAAIPGRIALTNAHTKENVLYEEILKLSCRLAESFKKYGLKQNDTIAVCSENSLQFFLPVIASLYLGIIVAPVNDKFVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRVVLMHTFEEKLFLQSLQDYKVESALLVPSLMAFLAKSALVEKYDFPHLKEIATGGWPLSKEIGEMVKKRFKLNFVRQGMGLSETTSAILITPKGDAKPGSTGKIVPLHAVKVVDPTTGKILGPNEPGELYFKGPMIMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKRLRGGVKFLDEIPKGSTGKIDRKVLRQMLEKHTNGHHHHHHHH

SEQ ID NO: 120 - protein, 552 aa, Artificial Sequence
  Variant of Photuris pennsylvanica
MADKNILYGPEPFYPLEDGTAGEQMFDALSRYAAIPGRIALTNAHTKENVLYEEILKLSCRLAESFKKYGLKQNDTIAVCSENSLQFFLPVIASLYLGIIVAPVNDKFVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRVVLMHTFEEKLFLQSLQDYKVESALLVPTLMAFLAKSALVEKYDFPHLKEIATGGWPLSKEIGEMVKKRFKLNFVRQGMGLSETTSAILITPRGDAKPGSTGKIVPLHAVKVVDPTTGKILGPNEPGELYFKGPMIMKGYYNNEEATKAIIDNDGWLRSGDIAYYDNDGHFYIVDRRKSLIKYKGYQVAPAEIEGILLQHPYIVDAGVTGIPDEAAGELPAAGVVVQTGKYLNEQIVQDYVASQVSTAKRLRGGVKFLDEIPKGSTGKIDRKVLRQMLEKHTNGHHHHHHHH

SEQ ID NO: 121 - protein, 552 aa, Artificial Sequence
  Variant of Photuris pennsylvanica
MADKNILYGPEPFYPLEDGTAGEQMFDALSRYAAIPGRIALTNAHTKENVLYEEILKLSCRLAESFKKYGLKQNDTIAVCSENSLQFFLPVIASLYLGIIVAPVNDKFVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTCGFRVVLMHTFEEKLFLQSLQDYKVESALLVPSLMAFLAKSALVEKYDFPHLKEIASGGWPLSKEIGEMVKKRFKLNFVRQGMGLSETTSAILITPRGDAKPGSTGKIVPLHAVKVVDPTTGKILGPNEPGELYFKGPMIMKGYYNNEEATKAIIDNDGWLRSGDIAYYDNDGHFYIVGRRKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 122 - protein, 552 aa, Artificial Sequence
  variant of Photuris pennsylvanica
MADKNILYGPEPFYPLEDGTAGEQMFDALSRYAAIPGRIALTNAHTKENVLYEEILKLSCRLAESFKKYGLKQNDTIAVCSENSLQFFLPVIASLYLGIIVAPVNDKFVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTRGFRVVLMHTFEEKLFLQSLQDYKVESALLVPTLMAFLAKSALVEKYDFPHLKEIATGGWPLSKEIGEMVKKRFKLNFVRQGMGLSETTSAILITPRGDAKPGSTGKIVPLHAVKVVDPTTGKILGPNEPGELYFKGPMIMKGYYNNEEATKAIIDNDGWLRSGDIAYYDNDGHFYIVGRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNGHHHHHHHH

SEQ ID NO: 123 - protein, 552 aa, Artificial Sequence
  variant of Photuris pennsylvanica
MADKNILYGPEPFYPLEDGTAGEQMFDALSRYAAIPGRIALTNAHTKENVLYEEILKLSCRLAESFKKYGLKQNDTIAVCSENSLQFFLPVIASLYLGIIVAPVNDKFVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTRGFRVVLMHTFEEKLFLQSLQDYKVESTLLVPSLMAFLAKSALVEKYDFPHLKEIATGGWPLSKEIGEMVKKRFKLNFVRQGMGLSETTSAILITPKGDAKPGSTGKIVPLHAVKVVDPTTGKILGPNEPGELYFKGPMIMKGYYNNEEATKAIIDNDGWLRSGDIAYYDNDGHFYIVGRRKSLIKYKGYQVAPAEIEGILLQHPYIVDAGVTGIPDEAAGELPAAGVVVQTGKYLNEQIVQDYVASQVSTAKRLRGGVKFLDEIPKGSTGKIDRKVLRQMLEKHTNGHHHHHHHH

SEQ ID NO: 124 - protein, 552 aa, Artificial Sequence
  variant of Photuris pennsylvanica
MADKNILYGPEPFYPLEDGTAGEQMFDALSRYAAIPGRIALTNAHTKENVLYEEILKLSCRLAESFKKYGLKQNDTIAVCSENSLQFFLPVIASLYLGIIVAPVNDKFVERELIHSLGIVKPRIVFCSKNTFQKVLNVKSKLKSIETIIILDLNEDLGGYQCLNNFISQNSDSNLDVKKFKPYSFNRDDQVAAIMFSSGTTGLPKGVMLTHKNIVARFSIAKDPTFGDAINPTSAILTVIPFHWGFGMMTTLGYFTRGFRVVLMHTFEEKLFLQSLQDYKVESALLVPSLMAFLAKSALVEKYDFPHLKEIATGGWPLSKEIGEMVKKRFKLNFVRQGMGLSETTSAILITPRGDAKPGSTGKIVPLHAVKVVDPTTGKILGPNEPGELYFKGPMIMKGYYNNEEATKAIIDNDGWLRSGDIAYYDNDGHFYIVGRRKSLIKYKGYQVAPAEIEGILLQHPYIVDAGVTGIPDEAAGELPAAGVVVQTGKYLNEQIVQDYVASQVSTAKRLRGGVKFLDEIPKGSTGKIDRKVLRQMLEKHTNGHHHHHHHH

SEQ ID NO: 125 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcgtcgattatgttttcttctggtacaactggtctgccgaagggagtcatgctaactcacaagaatattgttgcacgattttctattgcaaaagatcctacttttggtaacgcaattaatcccacgtcagcaattttaacggtaatacctttccaccatggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgatttatcgcacttaaaagaaattgcatctggtggcgcacctttatcaaaagaaattggggagatggtgaaaaaacggtttaaattaaactttgtcaggcaagggtatggattaacagaaaccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgataatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 126 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcgtcgattatgttttcttctggtacaactggtctgccgaagggagtcatgctaactcacaagaatattgttgcacgattttctattgcaaaagatcctacttttggtaacgcaattaatcccacgtcagcaattttaacggtattacctttccaccatggttttggtatgatgaccacattaggatcctttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgatttatcgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 127 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaatgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcgtcgattatgttttcttctggtacaactggtctgccgaagggagtcatgctaactcacaagaatattgttgcacgattttctattgcaaaagatcctacttttggtaacgcaattaatcccacgtcagcaattttaacggtaatacctttccaccgtggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattaggtgaaaagtacgatttatcgcacttaaaagaaattgcatctggtggcgcacctttatcaaaagaaattggggagatggtgaaaaaacggtttaaattaaactttgtcaggcaagggtatggattaacagaaaccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 128 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcgtcgattatgttttcttctggtacaactggtctgccgaagggagtcatgctaactcacaagaatattgttgcacgattttctattgcaaaagatcctacttttggtaacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgatttatcgcacttaaaagaaattgcatctggtggcgcacctttatcaaaagaaattggggagatggtgaaaaaacggtttaaattaaactttgtcaggcaagggtatggattaacagaaaccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgataatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 129 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcgtcgattatgttttcttctggtacaactggtctgccgaagggagtcatgctaactcacaagaatattgttgcacgattttctattgcaaaagatcctacttttggtaacgcaattaatcccacgtcagcaattttaacggtaatacctttccactggggttttggtatgatgaccacattaggatcctttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgatttatcgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 130 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcgtcgattatgttttcttctggtacaactggtctgccgaagggagtcatgctaactcacaagaatattgttgcacgattttctattgcaaaagatcctacttttggtaacgcaattaatcccacgtcagcaattttaacggtaatacctttccactggggttttggtatgatgaccacattaggatcctttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgatttatcgcacttaaaagaaattgcatctggtggcgcacctttatcaaaagaaattggggagatggtgaaaaaacggtttaaattaaactttgtcaggcaagggtatggattaacagaaaccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgataatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 131 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcgtcgattatgttttcttctggtacaactggtctgccgaagggagtcatgctaactcacaagaatattgttgcacgattttctattgcaaaagatcctacttttggtaacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgatttatcgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgataatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 132 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcgtcgattatgttttcttctggtacaactggtctgccgaagggagtcatgctaactcacaagaatattgttgcacgattttctattgcaaaagatcctacttttggtaacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgatttatcgcacttaaaagaaattgcatctggtggcgcacctttatcaaaagaaattggggagatggtgaaaaaacggtttaaattaaactttgtcaggcaagggtatggattaacagaaaccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 133 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcgtcgattatgttttcttctggtacaactggtctgccgaagggagtcatgctaactcacaagaatattgttgcacgattttctattgcaaaagatcctacttttggtaacgcaattaatcccacgtcagcaattttaacggtaatacctttccactggggttttggtatgatgaccacattaggatcctttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgatttatcgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgataatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 134 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcgtcgattatgttttcttctggtacaactggtctgccgaagggagtcatgctaactcacaagaatattgttgcacgattttctattgcaaaagatcctacttttggtaacgcaattaatcccacgtcagcaattttaacggtaatacctttccactggggttttggtatgatgaccacattaggatcctttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgatttatcgcacttaaaagaaattgcatctggtggcgcacctttatcaaaagaaattggggagatggtgaaaaaacggtttaaattaaactttgtcaggcaagggtatggattaacagaaaccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 135 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcgtcgattatgttttcttctggtacaactggtctgccgaagggagtcatgctaactcacaagaatattgttgcacgattttctattgcaaaagatcctacttttggtaacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgatttatcgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 136 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcgtcgattatgttttcttctggtacaactggtctgccgaagggagtcatgctaactcacaagaatattgttgcacgattttctattgcaaaagatcctacttttggtaacgcaattaatcccacgtcagcaattttaacggtattacctttccactggggttttggtatgatgaccacattaggatcctttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgatttatcgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 137 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcgtcgattatgttttcttctggtacaactggtctgccgaagggagtcatgctaactcacaagaatattgttgcacgattttctattgcaaaagatcctacttttggtaacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattaggtgaaaagtacgatttatcgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 138 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcgtcgattatgttttcttctggtacaactggtctgccgaagggagtcatgctaactcacaagaatattgttgcacgattttctattgcaaaagatcctacttttggtaacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattaggtgaaaagtacgatttttcgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 139 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcgtcgattatgttttcttctggtacaactggtctgccgaagggagtcatgctaactcacaagaatattgttgcacgattttctattgcaaaagatcctacttttggtaacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattaggtgaaaagtacgatttaccgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 140 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcgtcgattatgttttcttctggtacaactggtctgccgaagggagtcatgctaactcacaagaatattgttgcacgattttctattgcaaaagatcctacttttggtaacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattaggtgaaaagtacgattttccgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 141 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcgtcgattatgttttcttctggtacaactggtctgccgaagggagtcatgctaactcacaagaatattgttgcacgattttctattgcaaaagatcctacttttggtaacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 142 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgatttttcgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgccgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 143 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcgtcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttataccaacattaatggcatttcttgcaaaaagtgcattagttgaaaagtacgatttatcgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 144 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcgtcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattaggtgaaaagtacgatttttcgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 145 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcgtcgattatgttttcttctggtacaactggtctgccgaagggagtcatgctaactcacaagaatcttgttgcacgattttctattgcaaaagatcctacttttggtaacgcaattaatcccacgtcagcaattttaacggtaatacctttccactggggttttggtatgatgaccacattaggatactttacttgtggattccgagttgctctaatgcacacgtttgaagaaaaactatttctacaatcattacaagattataaagtggaaagtactttacttgtaccaacattaatggcatttcttgcaaaaagtgcattagttgaaaagtacgatttttcgcacttaaaagaaattgcatctggtggcgcacctttatcaaaagaaattggggagatggtgaaaaaacggtttaaattaaactttggcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 146 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcgtcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgatttttcgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 147 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgactttctattgcaaaagatcctacttttggtgacgcaattaatcccacgacagcaattttaacggtaatacctttccactggggttttggtatgatgaccacattaggatactttacttgtggattccgagttgctctaatgcacacgtttgaagaaaaactatttctacaatcattacaagattataaagtggaaagtactttacttgtaccaacattaatggcatttcatgcaaaaagtgcattagttgaaaagtacgattttccgcacttagaagaaattgcatctggtggctcacctttatcaaaagaaattggggagatggtgaaaaaacggtttaaattaaactttggcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaaatgttaagacaaatgttagaaaaacacaccaatgggcatcaccatcaccaccatcatcactaa

SEQ ID NO: 148 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 149 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcgtcgattatgttttcttctggtacaactggtctgccgaagggagtcatgctaactcacaagaatattgttgcacgattttctattgcaaaagatcctacttttggtaacgcaattaatcccacgtcagcaattttaacggtaatacctttccactggggttttggtatgatgaccacattaggatactttacttgtggattccgagttgctctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggcgcacctttatcaaaagaaattggggagatggtgaaaaaacggtttaaattaaactttggcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaaatgttaagacaaatgttagaaaaacacaccaatgggcatcaccatcaccaccatcatcactaa

SEQ ID NO: 150 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 151 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcataaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 152 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatcttgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 153 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgactttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 154 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatccctcgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 155 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgacagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 156 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcagttttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 157 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgctctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 158 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggcgcacctttatcaaaagaaattggggagatggtgaaaaaacggtttaaattaaactttggcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 159 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgcccgtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 160 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatcttgttgcacgactttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 161 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatccctcgacagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 162 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgacagcagttttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 163 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatccctcgtcagcagttttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 164 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcatttaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggcgcacctttatcaaaagaaattggggagatggtgaaaaaacggtttaaattaaactttggcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaatgattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 165 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggccgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaattcgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctataacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 166 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggccgcatagcattgacaaatgctcatacaaaagaaaatgttttatatgaagagattctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgctctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatgttgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 167 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaattcgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagctgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacgatgatggccatgtttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 168 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcatttaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 169 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacggactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 170 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacgttgaacgtgaattaatacacagtcttggtattgtaaaaccacgcatagttttttgctccaagaatacttttcaaaaagtactgaatgtaaaatctaaattaaaatctattgaaactattattatattagacttaagtgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagctgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaatgattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 171 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctgttcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagctgttctaatgcacacgtttgaagaaaaactatttctacaatcattacaagattataaagtggaaagtactttacttgtaccatcattaatggcatttcttgcaaaaagtgcattagttgaaaagtacgattttccgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 172 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttgtgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 173 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttatggtatgatgaccacattaggatactttacttgtggattccgagctgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 174 - DNA, 1659 bp, Artificial Sequence; identical to SEQ ID NO: 168
  variant of Photuris pennsylvanica

SEQ ID NO: 175 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacgttgaacgtgaattaatacacagtcttggtattgtacaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttatggtatgatgaccacattaggatactttacttgtggattccgagctgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 176 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacgttgaacgtgaattaatacacagtcttggtattgtacaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagctgttctaatgcacacgtttgaagaaaaactatttctacaatcattacaagattataaagtggaaagtactttacttataccaacattaatggcatttcttgcaaaaagtgcattagttgaaaagtacgattttccgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 177 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgatcaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcgacgattatgttttcttctggtacaactggtctgccgaagggagtcatgctaactcacaagaatattgttgcacgattttctattgcaaaagatcctacttttggtaacgcaattaatcccacgtcagcaattttaacggtaatacctttccactggggttttggtatgatgaccacattaggatactttacttgtggattccgagttgctctaatgcacacgtttgaagaaaaactatttctacaatcattacaagattataaagtggaaagtactttacttgtaccaacattaatggcatttcttgcaaaaagtgcattagttgaaaagtacgatttatcgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 178 - DNA, 1659 bp, Artificial Sequence; identical to SEQ ID NO: 143
  variant of Photuris pennsylvanica

SEQ ID NO: 179 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacatggaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcgttgattatgttttcttctggtacaactggtctgccgaagggagtcatgctaactcacaagaatattgttgcacgattttctattgcaaaagatcctacttttggtaacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgatttatcgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 180 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacatggaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcgttgattatgttttcttctggtacaactggtctgccgaagggagtcatgctaactcacaagaatattgttgcacgattttctattgcaaaagatcctacttttggtaacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcatgcaaaaagtgcattagttgaaaagtacgatttatcgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 181 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgatcaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcgtcgattatgttttcttctggtacaactggtctgccgaagggagtcatgctaactcacaagaatattgttgcacgattttctattgcaaaagatcctacttttggtaacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgatttttcgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 182 - DNA, 1659 bp, Artificial Sequence; identical to SEQ ID NO: 181
  variant of Photuris pennsylvanica

SEQ ID NO: 183 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcgttgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgatcaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcgacgattatgttttcttctggtacaactggtctgccgaagggagtcatgctaactcacaagaatattgttgcacgattttctattgcaaaagatcctacttttggtaacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgatttatcgcacttaaaagaaattgcatctggtggctcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 184 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcgtcgattatgttttcttctggtacaactggtctgccgaagggagtcatgctaactcacaagaatattgttgcacgattttctattgcaaaagatcctacttttggtaacgcaattaatcccacgtcagcaattttaacggtaatacctttccactggggttttggtatgatgaccacattaggatactttacttgtggattccgagttgctctaatgcacacgtttgaagaaaaactatttctacaatcattacaagattataaagtggaaagtactttacttataccaacattaatggcatttcttgcaaaaagtgcattagttgaaaagtacgatttatcgcacttaaatgaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 185 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcgccgattatgttttcttctggtacaactggtctgccgaagggagtcatgctaactcacaagaatattgttgcacgattttctattgcaaaagatcctacttttggtaacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgatttatcgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 186 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacatggaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcgtcgattatgttttcttctggtacaactggtctgccgaagggagtcatgctaactcacaagaatattgttgcacgattttctattgcaaaagatcctacttttggtaacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgatttatcgcacttaaaagaaattgcatctggtggctcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 187 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaatccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcgtcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttataccaacattaatggcatttcttgcaaaaagtgcattagttgaaaagtacgatttatcgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 188 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaattcattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcgtcgattatgttttcttctggtacaactggtctgccgaagggagtcatgctaactcacaagaatattgttgcacgattttctattgcaaaagatcctacttttggtaacgcaattaatcccacgtcagcaattttaacggtaatacctttccactggggttttggtatgatgaccacattaggatactttacttgtggattccgagttgctctaatgcacacgtttgaagaaaaactatttctacaatcattacaagattataaagtggaaagtactttacttgtaccaacattaatggcatttcttgcaaaaagtgcattagttgaaaagtacgatttttcgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 189 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcgtcgattatgttttcttctggtacaactggtctgccgaagggagtcatgctaactcacaagaatattgttgcacgattttctattgcaaaagatcctacttttggtaacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgatttaccgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 190 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgatcaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcgtcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgatttatcgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 191 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcgtcgattatgttttcttctggtacaactggtctgccgaagggagtcatgctaactcacaagaatattgttgcacgattttctattgcaaaagatcctacttttggtaacgcaattaatcccacgtcagcagttttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgatttatcgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 192 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcgtcgattatgttttcttctggtacaactggtctgccgaagggagtcatgctaactcacaagaatattgttgcacgattttctattgcaaaagatcctacttttggtaacgcaattaatcccacgtcagcaattttaacggtaatacctttccaccatggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgatttatcgcacttaaaagaaattgcatctggtggcgcacctttatcaaaagaaattggggagatggtgaaaaaacggtttaaattaaactttgtcaggcaagggtatggattaacagaaaccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgataatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 193 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtaacgcaattaatcccacgtcagcaattttaacggtaatacctttccaccatggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgatttatcgcacttaaaagaaattgcatctggtggcgcacctttatcaaaagaaattggggagatggtgaaaaaacggtttaaattaaactttgtcaggcaagggtatggattaacagaaaccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgataatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 194 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcgtcgattatgttttcttctggtacaactggtctgccgaagggagtcatgctaactcacaagaatattgttgcacgattttctattgcaaaagatcctacttttggtaacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgatttttcgcacttaaaagaaattgcatctggtggcgcacctttatcaaaagaaattggggagatggtgaaaaaacggtttaaattaaactttgtcaggcaagggtatggattaacagaaaccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgataatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 195 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcgtcgattatgttttcttctggtacaactggtctgccgaagggagtcatgctaactcacaagaatattgttgcacgattttctattgcaaaagatcctacttttggtaacgcaattaatcccacgtcagcaattttaacggtaatacctttccaccatggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgatttaccgcacttaaaagaaattgcatctggtggcgcacctttatcaaaagaaattggggagatggtgaaaaaacggtttaaattaaactttgtcaggcaagggtatggattaacagaaaccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgataatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 196 - DNA, 1659 bp, Artificial Sequence; identical to SEQ ID NO: 125
  variant of Photuris pennsylvanica

SEQ ID NO: 197 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcgtcgattatgttttcttctggtacaactggtctgccgaagggagtcatgctaactcacaagaatattgttgcacgattttctattgcaaaagatcctacttttggtaacgcaattaatcccacgtcagcaattttaacggtaatacctttccaccatggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgatttatcgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgataatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 198 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcgtcgattatgttttcttctggtacaactggtctgccgaagggagtcatgctaactcacaagaatattgttgcacgattttctattgcaaaagatcctacttttggtaacgcaattaatcccacgtcagcaattttaacggtaatacctttccaccatggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgatttatcgcacttaaaagaaattgcatctggtggcgcacctttatcaaaagaaattggggagatggtgaaaaaacggtttaaattaaactttgtcaggcaagggtatggattaacagaaaccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 199 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacattgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcgtcgattatgttttcttctggtacaactggtctgccgaagggagtcatgctaactcacaagaatattgttgcacgattttctattgcaaaagatcctacttttggtaacgcaattaatcccacgtcagcaattttaacggtaatacctttccaccatggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgatttatcgcacttaaaagaaattgcatctggtggcgcacctttatcaaaagaaattggggagatggtgaaaaaacggtttaaattaaactttgtcaggcaagggtatggattaacagaaaccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgctaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 200 - DNA, 1659 bp, Artificial Sequence; identical to SEQ ID NO: 148
  variant of Photuris pennsylvanica

SEQ ID NO: 201 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcgtcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 202 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccaccatggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 203 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgatttaccgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 204 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgatttttcgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 205 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggcgcacctttatcaaaagaaattggggagatggtgaaaaaacggtttaaattaaactttgtcaggcaagggtatggattaacagaaaccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 206 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgataatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 207 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtaacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 208 - DNA, 1659 bp, Artificial Sequence; identical to SEQ ID NO: 150
  variant of Photuris pennsylvanica

SEQ ID NO: 209 - DNA, 1659 bp, Artificial Sequence; identical to SEQ ID NO: 150
  variant of Photuris pennsylvanica

SEQ ID NO: 210 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggcgcacctttatcaaaagaaattggggagatggtgaaaaaacggtttaaattaaactttgtcaggcaagggtatggattaacagaagccacttcggctatcttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 211 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggcatgcctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 212 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggctggcctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 213 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggcgcacctttatcaaaagaaattggggagatggtgaaaaaacggtttaaattaaactttgtcaggcaagggatgggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 214 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggcgcacctttatcaaaagaaattggggagatggtgaaaaaacggtttaaattaaactttgtcaggcaagggtatggattaagcgaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 215 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggcgcacctttatcaaaagaaattggggagatggtgaaaaaacggtttaaattaaactttgtcaggcaagggtatggattaacagaaatcacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 216 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggctggcctttatcaaaagaaattggggagatggtgaaaaaacggtttaaattaaactttgtcaggcaagggtatggattaacagaaatcacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 217 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggctgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataattacgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccatcattaatggcatttcttgcaaaaagtgcattagttgaaaagtacgattttccgcacttaaaagaaattgcatctggtggcgcacctttatcaaaagaaattggggagatggtgaaaaaacggtttaaattaaactttgtcaggcaagggtatggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 218 - DNA, 1659 bp, Artificial Sequence; identical to SEQ ID NO: 176
  variant of Photuris pennsylvanica

SEQ ID NO: 219 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggccgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggctggcctttatcaaaagaaattggggagatggtgaaaaaacggtttaaattaaactttgtcaggcaagggtatggattaagcgaagccacttcggctatcttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 220 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggccgcatagcattgacaaatgctcatacaaaagaaaatgttttatatgaagagattctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggctggcctttatcaaaagaaattggggagatggtgaaaaaacggtttaaattaaactttgtcaggcaagggtatggattaagcgaaaccacttcggctatcttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgataatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 221 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggccgcatagcattgacaaatgctcatacaaaagaaaatgttttatatgaagagtttctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaacggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggctggcctttatcaaaagaaattggggagatggtgaaaaaacggtttaaattaaactttgtcaggcaagggtatggattaagcgaagccacttcggctatcttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 222 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggccgcatagcattgacaaatgctcatacaaaagaaaatgttttatatgaagagattctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggctggcctttatcaaaagaaattggggagatggtgaaaaaacggtttaaattaaactttgtcaggcaagggtatggattaagcgaagccacttcggctatcttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 223 - DNA, 1659 bp, Artificial Sequence; identical to SEQ ID NO: 222
  variant of Photuris pennsylvanica

SEQ ID NO: 224 - DNA, 1659 bp, Artificial Sequence; identical to SEQ ID NO: 222
  variant of Photuris pennsylvanica

SEQ ID NO: 225 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggccgcatagcattgacaaatgctcatacaaaagaaaatgttttatatgaagagattctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaattcgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggctggcctttatcaaaagaaattggggagatggtgaaaaaacggtttaaattaaactttgtcaggcaagggatgggattaacagaaatcacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 226 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggccgcatagcattgacaaatgctcatacaaaagaaaatgttttatatgaagagattctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggctggcctttatcaaaagaaattggggagatggtgaaaaaacggtttaaattaaactttgtcaggcaagggtatggattaagcgaaatcacttcggctatcttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 227 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggccgcatagcattgacaaatgctcatacaaaagaaaatgttttatatgaagagattctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaattcgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggctggcctttatcaaaagaaattggggagatggtgaaaaaacggtttaaattaaactttgtcaggcaagggatgggattaacagaagccacttcggctgttttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 228 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggccgcatagcattgacaaatgctcatacaaaagaaaatgttttatatgaagagattctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaattcgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggctggcctttatcaaaagaaattggggagatggtgaaaaaacggtttaaattaaactttgtcaggcaagggatgggattaagcgaaaccacttcggctatcttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgataatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 229 - DNA, 1659 bp, Artificial Sequence; identical to SEQ ID NO: 225
  variant of Photuris pennsylvanica

SEQ ID NO: 230 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggccgcatagcattgacaaatgctcatacaaaagaaaatgttttatatgaagagattctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaatacgttgaacgtgaattaatacacagtcttggtattgtacaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggctggcctttatcaaaagaaattggggagatggtgaaaaaacggtttaaattaaactttgtcaggcaagggatgggattaacagaaatcacttcggctatcttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgaaaatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 231 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggccgcatagcattgacaaatgctcatacaaaagaaaatgttttatatgaagagattctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaattcgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtagtacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggctggcctttatcaaaagaaattggggagatggtgaaaaaacggtttaaattaaactttgtcaggcaagggatgggattaagcgaaaccacttcggctatcttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgataatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 232 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggccgcatagcattgacaaatgctcatacaaaagaaaatgttttatatgaagagattctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaattcgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtgctttacttgtaccaacattaatggcatttcttgcaaaaagtgcattagttgaaaagtacgattttccgcacttaaaagaaattgcatctggtggctggcctttatcaaaagaaattggggagatggtgaaaaaacggtttaaattaaactttgtcaggcaagggatgggattaagcgaaaccacttcggctatcttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgataatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 233 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggccgcatagcattgacaaatgctcatacaaaagaaaatgttttatatgaagagattctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaattcgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaagattaatggcatttcttgcaaaaagtgcattagttgaaaagtacgattttccgcacttaaaagaaattgcatctggtggctggcctttatcaaaagaaattggggagatggtgaaaaaacggtttaaattaaactttgtcaggcaagggatgggattaagcgaaaccacttcggctatcttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgataatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 234 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggccgcatagcattgacaaatgctcatacaaaagaaaatgttttatatgaagagattctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaattcgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggctggcctttatcaaaagaaattggggagatggtgaaaaaacggtttaaattaaactttgtcaggcaagggatgggattaagcgaaaccacttcggctatcttaattacaccgagaggtgacgccaaaccgggatcaactggtaaaatagtaccattacacgctgttaaagttgtcgatcctacaacaggaaaaattttggggccaaatgaacctggagaattgtattttaaaggcccgatgataatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 235 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggccgcatagcattgacaaatgctcatacaaaagaaaatgttttatatgaagagattctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaattcgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggctggcctttatcaaaagaaattggggagatggtgaaaaaacggtttaaattaaactttgtcaggcaagggatgggattaagcgaaaccacttcggctatcttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgataatgaagggttattataataatgaagaagctactaaagcaattattgataatgacggatggttgcgctctggtgatattgcttattatgacaatgatggccatttttatattgtgggcaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 236 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggccgcatagcattgacaaatgctcatacaaaagaaaatgttttatatgaagagattctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaattcgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggctggcctttatcaaaagaaattggggagatggtgaaaaaacggtttaaattaaactttgtcaggcaagggatgggattaagcgaaaccacttcggctatcttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgataatgaagggttattataataatgaagaagctactaaagcaattattgataatgacggatggttgcgctctggtgatattgcttattatgacaatgatggccatttttatattgtggacaggcggaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 237 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggccgcatagcattgacaaatgctcatacaaaagaaaatgttttatatgaagagattctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaattcgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggctggcctttatcaaaagaaattggggagatggtgaaaaaacggtttaaattaaactttgtcaggcaagggatgggattaagcgaaaccacttcggctatcttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgataatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaacggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 238 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggccgcatagcattgacaaatgctcatacaaaagaaaatgttttatatgaagagattctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaattcgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcaactggtggctggcctttatcaaaagaaattggggagatggtgaaaaaacggtttaaattaaactttgtcaggcaagggatgggattaagcgaaaccacttcggctatcttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgataatgaagggttattataataatgaagaagctactaaagcaattattgataatgacggatggttgcgctctggtgatattgcttattatgacaatgatggccatttttatattgtgggcaggcggaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 239 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggccgcatagcattgacaaatgctcatacaaaagaaaatgttttatatgaagagattctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaattcgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttactcgtggattccgagttgttctaatgcacacgtttgaagaaaaactatttctacaatcattacaagattataaagtggaaagtgctttacttgtaccatcattaatggcatttcttgcaaaaagtgcattagttgaaaagtacgattttccgcacttaaaagaaattgcatctggtggctggcctttatcaaaagaaattggggagatggtgaaaaaacggtttaaattaaactttgtcaggcaagggatgggattaagcgaaaccacttcggctatcttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgataatgaagggttattataataatgaagaagctactaaagcaattattgataatgacggatggttgcgctctggtgatattgcttattatgacaatgatggccatttttatattgtggacaggcggaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 240 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggccgcatagcattgacaaatgctcatacaaaagaaaatgttttatatgaagagattctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaattcgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttactcgtggattccgagttgttctaatgcacacgtttgaagaaaaactatttctacaatcattacaagattataaagtggaaagtactttacttgtaccaacattaatggcatttcttgcaaaaagtgcattagttgaaaagtacgattttccgcacttaaaagaaattgcatctggtggctggcctttatcaaaagaaattggggagatggtgaaaaaacggtttaaattaaactttgtcaggcaagggatgggattaagcgaaaccacttcggctatcttaattacaccgagaggtgacgccaaaccgggatcaactggtaaaatagtaccattacacgctgttaaagttgtcgatcctacaacaggaaaaattttggggccaaatgaacctggagaattgtattttaaaggcccgatgataatgaagggttattataataatgaagaagctactaaagcaattattgataatgacggatggttgcgctctggtgatattgcttattatgacaatgatggccatttttatattgtggacaggcggaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaacggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 241 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggccgcatagcattgacaaatgctcatacaaaagaaaatgttttatatgaagagattctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaattcgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtactttacttgtaccatcattaatggcatttcttgcaaaaagtgcattagttgaaaagtacgattttccgcacttaaaagaaattgcatctggtggctggcctttatcaaaagaaattggggagatggtgaaaaaacggtttaaattaaactttgtcaggcaagggatgggattaagcgaaaccacttcggctatcttaattacaccgagaggtgacgccaaaccgggatcaactggtaaaatagtaccattacacgctgttaaagttgtcgatcctacaacaggaaaaattttggggccaaatgaacctggagaattgtattttaaaggcccgatgataatgaagggttattataataatgaagaagctactaaagcaattattgataatgacggatggttgcgctctggtgatattgcttattatgacaatgatggccatttttatattgtgggcaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaacggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 242 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggccgcatagcattgacaaatgctcatacaaaagaaaatgttttatatgaagagattctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaattcgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttactcgtggattccgagttgttctaatgcacacgtttgaagaaaaactatttctacaatcattacaagattataaagtggaaagtactttacttgtaccatcattaatggcatttcttgcaaaaagtgcattagttgaaaagtacgattttccgcacttaaaagaaattgcaactggtggctggcctttatcaaaagaaattggggagatggtgaaaaaacggtttaaattaaactttgtcaggcaagggatgggattaagcgaaaccacttcggctatcttaattacaccgagaggtgacgccaaaccgggatcaactggtaaaatagtaccattacacgctgttaaagttgtcgatcctacaacaggaaaaattttggggccaaatgaacctggagaattgtattttaaaggcccgatgataatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 243 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggccgcatagcattgacaaatgctcatacaaaagaaaatgttttatatgaagagattctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaattcgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtgctttacttgtaccatcattaatggcatttcttgcaaaaagtgcattagttgaaaagtacgattttccgcacttaaaagaaattgcaactggtggctggcctttatcaaaagaaattggggagatggtgaaaaaacggtttaaattaaactttgtcaggcaagggatgggattaagcgaaaccacttcggctatcttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgataatgaagggttattataataatgaagaagctactaaagcaattattgataatgacggatggttgcgctctggtgatattgcttattatgacaatgatggccatttttatattgtggacaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaacggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 244 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggccgcatagcattgacaaatgctcatacaaaagaaaatgttttatatgaagagattctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaattcgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtgctttacttgtaccaacattaatggcatttcttgcaaaaagtgcattagttgaaaagtacgattttccgcacttaaaagaaattgcaactggtggctggcctttatcaaaagaaattggggagatggtgaaaaaacggtttaaattaaactttgtcaggcaagggatgggattaagcgaaaccacttcggctatcttaattacaccgagaggtgacgccaaaccgggatcaactggtaaaatagtaccattacacgctgttaaagttgtcgatcctacaacaggaaaaattttggggccaaatgaacctggagaattgtattttaaaggcccgatgataatgaagggttattataataatgaagaagctactaaagcaattattgataatgacggatggttgcgctctggtgatattgcttattatgacaatgatggccatttttatattgtggacaggcggaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaacggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 245 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggccgcatagcattgacaaatgctcatacaaaagaaaatgttttatatgaagagattctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaattcgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttacttgtggattccgagttgttctaatgcacacgtttgaagaaaaactatttctacaatcattacaagattataaagtggaaagtgctttacttgtaccatcattaatggcatttcttgcaaaaagtgcattagttgaaaagtacgattttccgcacttaaaagaaattgcatctggtggctggcctttatcaaaagaaattggggagatggtgaaaaaacggtttaaattaaactttgtcaggcaagggatgggattaagcgaaaccacttcggctatcttaattacaccgagaggtgacgccaaaccgggatcaactggtaaaatagtaccattacacgctgttaaagttgtcgatcctacaacaggaaaaattttggggccaaatgaacctggagaattgtattttaaaggcccgatgataatgaagggttattataataatgaagaagctactaaagcaattattgataatgacggatggttgcgctctggtgatattgcttattatgacaatgatggccatttttatattgtgggcaggcggaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 246 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggccgcatagcattgacaaatgctcatacaaaagaaaatgttttatatgaagagattctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaattcgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttactcgtggattccgagttgttctaatgcacacgtttgaagaaaaactatttctacaatcattacaagattataaagtggaaagtgctttacttgtaccaacattaatggcatttcttgcaaaaagtgcattagttgaaaagtacgattttccgcacttaaaagaaattgcaactggtggctggcctttatcaaaagaaattggggagatggtgaaaaaacggtttaaattaaactttgtcaggcaagggatgggattaagcgaaaccacttcggctatcttaattacaccgagaggtgacgccaaaccgggatcaactggtaaaatagtaccattacacgctgttaaagttgtcgatcctacaacaggaaaaattttggggccaaatgaacctggagaattgtattttaaaggcccgatgataatgaagggttattataataatgaagaagctactaaagcaattattgataatgacggatggttgcgctctggtgatattgcttattatgacaatgatggccatttttatattgtgggcaggctgaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaatggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 247 - DNA, 1659 bp, Artificial Sequence
  variant of Photuris pennsylvanica
atggctgacaaaaacatcctgtatggtccggaaccgttctacccactggaagatggtaccgctggtgaacagatgtttgacgcattatctcgttatgcagctattccgggccgcatagcattgacaaatgctcatacaaaagaaaatgttttatatgaagagattctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaattcgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttactcgtggattccgagttgttctaatgcacacgtttgaagaaaaactatttctacaatcattacaagattataaagtggaaagtactttacttgtaccatcattaatggcatttcttgcaaaaagtgcattagttgaaaagtacgattttccgcacttaaaagaaattgcaactggtggctggcctttatcaaaagaaattggggagatggtgaaaaaacggtttaaattaaactttgtcaggcaagggatgggattaagcgaaaccacttcggctatcttaattacaccgaaaggtgacgccaaaccgggatcaactggtaaaatagtaccattacacgctgttaaagttgtcgatcctacaacaggaaaaattttggggccaaatgaacctggagaattgtattttaaaggcccgatgataatgaagggttattataataatgaagaagctactaaagcaattattgataatgacggatggttgcgctctggtgatattgcttattatgacaatgatggccatttttatattgtgggcaggcggaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaacggctacgtggtggggtgaaatttttggatgaaattcccaaaggatcaactggaaaaattgacagaaaagtgttaagacaaatgttagaaaaacacaccaatgggcatcaccatcaccaccatcatcactaa

SEQ ID NO: 248 - DNA, 1659 bp, Artificial Sequence
  Variant of Photuris pennsylvanica
atggctgacaaaaacatcctgtatggtccggaaccgttctacccactggaagatggtaccgctggtgaacagatgtttgacgcattatctcgttatgcagctattccgggccgcatagcattgacaaatgctcatacaaaagaaaatgttttatatgaagagattctgaaactgtcgtgtcgtttagcggaaagttttaaaaagtatggattaaaacaaaacgacacaatagcggtgtgtagcgaaaatagtctgcaatttttccttcctgtaattgcatcattgtatcttggaataattgtggcacctgttaacgataaattcgttgaacgtgaattaatacacagtcttggtattgtaaaaccacgcatagttttttgctccaagaatacttttcaaaaagtactgaatgtaaaatctaaattaaaatctattgaaactattattatattagacttaaatgaagacttaggaggttatcaatgcctcaacaactttatttctcaaaattccgatagtaatctggacgtaaaaaaatttaaaccctattcttttaatcgagacgatcaggttgcggcgattatgttttcttctggtacaactggtctgccgaagggagtcatgctaactcacaagaatattgttgcacgattttctattgcaaaagatcctacttttggtgacgcaattaatcccacgtcagcaattttaacggtaatacctttccactggggttttggtatgatgaccacattaggatactttactcgtggattccgagttgttctaatgcacacgtttgaagaaaaactatttctacaatcattacaagattataaagtggaaagtgctttacttgtaccatcattaatggcatttcttgcaaaaagtgcattagttgaaaagtacgattttccgcacttaaaagaaattgcaactggtggctggcctttatcaaaagaaattggggagatggtgaaaaaacggtttaaattaaactttgtcaggcaagggatgggattaagcgaaaccacttcggctatcttaattacaccgagaggtgacgccaaaccgggatcaactggtaaaatagtaccattacacgctgttaaagttgtcgatcctacaacaggaaaaattttggggccaaatgaacctggagaattgtattttaaaggcccgatgataatgaagggttattataataatgaagaagctactaaagcaattattgataatgacggatggttgcgctctggtgatattgcttattatgacaatgatggccatttttatattgtgggcaggcggaagtcactgattaaatataaaggttatcaggttgcacctgctgaaattgagggaatactcttacaacatccgtatattgttgatgccggcgttactggtataccggatgaagccgcgggcgagcttccagctgcaggtgttgtagtacagactggaaaatatctaaacgaacaaatcgtacaagattatgttgccagtcaagtttcaacagccaaacggctacgtggtggggtgaaatttttggatgaaattcccaaaggatcaactggaaaaattgacagaaaagtgttaagacaaatgttagaaaaacacaccaatgggcatcaccatcaccaccatcatcactaa

What is claimed is:

1. A luciferase polypeptide capable of producing an increased bioluminescent signal in the presence of a 5,5-disubstituted luciferin compared to a bioluminescent signal produced by a luciferase polypeptide of SEQ ID NO: 1 in the presence of the 5,5-disubstituted luciferin, wherein the luciferase polypeptide is not naturally occurring and comprises at least 90% sequence identity with the amino acid sequence of SEQ ID NO: 2 and less than 100% sequence identity with the amino acid sequence of SEQ ID NO: 1, wherein the polypeptide comprises amino acid substitution H244W or H244G relative to the amino acid sequence of SEQ ID NO: 1.

2. The polypeptide of claim 1, wherein the polypeptide comprises at least one additional amino acid substitution at positions 249, 337, and/or 339 relative to the amino acid sequence of SEQ ID NO: 1.

3. The polypeptide of claim 1, wherein the polypeptide comprises at least one additional amino acid substitution at positions 240, 254, and/or 344 relative to the amino acid sequence of SEQ ID NO: 1.

4. The polypeptide of claim 3, wherein the at least one amino acid substitution is selected from I240L, Y254S, and T344A, and/or any conservative or semi-conservative variations of the at least one amino acid substitution.

5. The polypeptide of claim 1, wherein the polypeptide comprises at least one additional amino acid substitution at positions 300 and/or 396 relative to the amino acid sequence of SEQ ID NO: 1.

6. The polypeptide of claim 5, wherein the at least one amino acid substitution is selected from V300G and I396K, and/or any conservative or semi-conservative variations of the at least one amino acid substitution.

7. The polypeptide of claim 1, wherein the polypeptide comprises at least one additional amino acid substitution at positions 245, 285 and/or 315 relative to the amino acid sequence of SEQ ID NO: 1.

8. The polypeptide of claim 7, wherein the at least one amino acid substitution is selected from G245A, L285I, and G315A, and/or any conservative or semi-conservative variations of the at least one amino acid substitution.

9. The polypeptide of claim 1, wherein the polypeptide comprises at least one additional amino acid substitution at positions 109, 193, 214, 218, 228, 234, 262, 287, 294, 305, 306, 309, 316, 335, and/or 533 relative to the amino acid sequence of SEQ ID NO: 1.

10. The polypeptide of claim 9, wherein the at least one amino acid substitution is selected from I109V, S193A, I214L, F218L, N228D, S234T, V262A, V287I, L294H, L305F, S306P, K309E, A316S, V335G, and/or V533M, and/or any conservative or semi-conservative variations of the at least one amino acid substitution.

11. The polypeptide of claim 1, wherein the polypeptide comprises at least one additional amino acid substitution at positions 133, 233, 236, and/or 503 relative to the amino acid sequence of SEQ ID NO: 1.

12. The polypeptide of claim 11, wherein the at least one amino acid substitution is selected from Q133H, T233S, I236V, and/or S503R and/or any conservative or semi-conservative variations of the at least one amino acid substitution.

13. The polypeptide of claim 1, wherein the polypeptide comprises at least one additional amino acid substitution at positions 107 and/or 121 relative to the amino acid sequence of SEQ ID NO: 1.

14. The polypeptide of claim 13, wherein the at least one amino acid substitution is selected from K107Q and/or K121N and/or any conservative or semi-conservative variations of the at least one amino acid substitution.

15. The polypeptide of claim 1, wherein the polypeptide is resistant to inhibition by dehydroluciferin and derivatives thereof compared to inhibition of the luciferase polypeptide of SEQ ID NO: 1 by the dehydroluciferin and derivatives thereof.

16. The polypeptide of claim 1, wherein the bioluminescent signal produced by the luciferase polypeptide is increased at least 10-fold compared to the bioluminescent signal produced by the luciferase polypeptide of SEQ ID NO: 1.

17. The polypeptide of claim 1, wherein the polypeptide comprises amino acid substitutions H244W, T344A, I396K, S193A, N228D, L305F, S306P, and I109V relative to the amino acid sequence of SEQ ID NO: 1, and/or any conservative or semi-conservative variations of the amino acid substitutions.

18. The polypeptide of claim 17, wherein the polypeptide comprises at least one additional amino acid substitution selected from the group consisting of V348I, A316M, A316W, Y339M, T342S, A344I, K121Q, V261A, V287I, K107N, and T289S relative to the amino acid sequence of SEQ ID NO: 1, and/or conservative or semi-conservative variations of the acid substitution(s).

19. The polypeptide of claim 17, wherein the polypeptide further comprises amino acid substitution A316W relative to the amino acid sequence of SEQ ID NO: 1, and/or any conservative or semi-conservative variations of the amino acid substitution.

20. The polypeptide of claim 17, wherein the polypeptide comprises at least one additional amino acid substitution selected from the group consisting of C38R, F55I, A316W, T342S, V348I, K205N, I396I, K121Q, Y339M, T344I, and Y108F relative to the amino acid sequence of SEQ ID NO: 1, and/or conservative or semi-conservative variations of the amino acid substitution(s).

21. The polypeptide of claim 17, wherein the polypeptide comprises at least one additional amino acid substitution selected from the group consisting of T344I, C38R, F55I, A316W, T342S, V348I, Y108F, Y339M, I240V, T284A, T289R, T289S, K353R, D435G, L437R, W510R, C257R, and S313T relative to the amino acid sequence of SEQ ID NO: 1, and/or any conservative or semi-conservative variations of the amino acid substitution(s).

22. A reagent composition for a bioluminescent assay, the composition comprising: a luciferase polypeptide capable of producing an increased bioluminescent signal in the presence of a 5,5-disubstituted luciferin compared to a bioluminescent signal produced by a luciferase polypeptide of SEQ ID NO: 1 in the presence of the 5,5-disubstituted luciferin, wherein the polypeptide comprises at least 90% sequence identity with the amino acid sequence of SEQ ID NO: 2 and less than 100% sequence identity with the amino acid sequence of SEQ ID NO: 1, and wherein the polypeptide comprises amino acid substitution H244W or H244G relative to the amino acid sequence of SEQ ID NO: 1; and a substrate for the luciferase polypeptide.

23. A kit comprising: a luciferase polypeptide capable of producing an increased bioluminescent signal in the presence of a 5,5-disubstituted luciferin compared to a bioluminescent signal produced by a luciferase polypeptide of SEQ ID NO: 1 in the presence of the 5,5-disubstituted luciferin, wherein the polypeptide comprises at least 90% sequence identity with the amino acid sequence of SEQ ID NO: 2 and less than 100% sequence identity with the amino acid sequence of SEQ ID NO: 1, and wherein the polypeptide comprises amino acid substitution H244W or H244G relative to the amino acid sequence of SEQ ID NO: 1; and a luciferin.

24. The polypeptide of claim 1, wherein the 5,5-disubstituted luciferin is selected from the group consisting of: CS0280, CS0333, CS0397, CS0431, CS0510, CS0404, CS0427, CS0326, CS0396, CS0325, CS0420, CS0392, CS0388, CS0465, CS0469, CS0579, CS0673, CS0670, and CS0565.

25. The composition of claim 22, wherein the 5,5-disubstituted luciferin is selected from the group consisting of: CS0280, CS0333, CS0397, CS0431, CS0510, CS0404, CS0427, CS0326, CS0396, CS0325, CS0420, CS0392, CS0388, CS0465, CS0469, CS0579, CS0673, CS0670, and CS0565.

26. The kit of claim 23, wherein the substrate for the luciferase polypeptide is a 5,5-disubstituted luciferin selected from the group consisting of: CS0280, CS0333, CS0397, CS0431, CS0510, CS0404, CS0427, CS0326, CS0396, CS0325, CS0420, CS0392, CS0388, CS0465, CS0469, CS0579, CS0673, CS0670, and CS0565.

* * * * *

UNITED STATES PATENT AND TRADEMARK OFFICE
CERTIFICATE OF CORRECTION

PATENT NO. : 11,767,517 B2
APPLICATION NO. : 16/432674
DATED : September 26, 2023
INVENTOR(S) : Michael Killoran et al.

It is certified that error appears in the above-identified patent and that said Letters Patent is hereby corrected as shown below:

In the Claims

Claim 17, Column 60, Line 10, "1396K" should read --I396K--

Signed and Sealed this
Twenty-sixth Day of March, 2024

*Katherine Kelly Vidal*

Katherine Kelly Vidal
*Director of the United States Patent and Trademark Office*